(12) United States Patent
Simón Buela et al.

(10) Patent No.: US 8,153,363 B2
(45) Date of Patent: *Apr. 10, 2012

(54) METHODS AND PRODUCTS FOR IN VITRO GENOTYPING

(75) Inventors: Laureano Simón Buela, Derio (ES); Antonio Martínez Martínez, Derio (ES); Diego Tejedor Hernández, Derio (ES); Elisa Jiménez Uribe, Derio (ES); Monica López Martínez, Derio (ES); Marta Artieda Oseñalde, Derio. Bizkaia (ES); Lorena Hernández García, Derio (ES)

(73) Assignee: Progenika Biopharma S.A., Derio (ES)

( * ) Notice: Subject to any disclaimer, the term of this patent is extended or adjusted under 35 U.S.C. 154(b) by 385 days.

This patent is subject to a terminal disclaimer.

(21) Appl. No.: 12/499,076

(22) Filed: Jul. 7, 2009

(65) Prior Publication Data

US 2010/0068710 A1 Mar. 18, 2010

Related U.S. Application Data

(63) Continuation-in-part of application No. 11/813,646, filed as application No. PCT/IB2006/000796 on Jan. 12, 2006, now Pat. No. 7,914,990.

(60) Provisional application No. 60/758,192, filed on Jan. 12, 2006.

(30) Foreign Application Priority Data

Jan. 13, 2005 (ES) .................................. 200500089
Oct. 5, 2005 (ES) .................................. 200502423

(51) Int. Cl.
*C12Q 1/68* (2006.01)

(52) U.S. Cl. .......................................................... 435/6
(58) Field of Classification Search ........................ None
See application file for complete search history.

(56) References Cited

U.S. PATENT DOCUMENTS

| 7,914,990 B2 * | 3/2011 | Buela et al. ............... 435/6.11 |
| 2004/0126782 A1 * | 7/2004 | Holden et al. ............... 435/6 |

FOREIGN PATENT DOCUMENTS

| ES | P200500089 | 1/2005 |
| ES | P200502423 | 10/2005 |
| WO | WO 00/58516 | 10/2000 |
| WO | WO 01/29269 A2 | 4/2001 |

OTHER PUBLICATIONS

Chen et al. (Genome Res. Apr. 2000;10(4):549-57).*
Chee, et al. Accessing genetic information with high-density DNA arrays., Science. Oct. 25, 1996;274(5287):610-4.
Cutler, et al. High-throughput variation detection and genotyping using microarrays., Genome Res. Nov. 2001;11(11):1913-25.
Hacia, et al. Detection of heterozygous mutations in BRCA1 using high density oligonucleotide arrays and two-colour fluorescence analysis. Nat Genet. Dec. 1996;14(4):441-7.
Kozal, et al. Extensive polymorphisms observed in HIV-1 clade B protease gene using high-density oligonucleotide arrays. Nat Med. Jul. 1996;2(7):753-9.
Sapolsky, et al. High-throughput polymorphism screening and genotyping with high-density oligonucleotide arrays., Genet Anal. Feb. 1999;14(5-6):187-92.
Jena Bioscience, GmbH, "Biotin PCR Labeling Core Kit," http://www.jenabioscience.com/images/0ea5cbe470/PP-303-BIO.pdf, 2009 (2 pages).

* cited by examiner

*Primary Examiner* — Christopher M. Babic
(74) *Attorney, Agent, or Firm* — Klarquist Sparkman, LLP

(57) ABSTRACT

An in vitro method for genotyping genetic variations in an individual, and products for use in the method.

56 Claims, 2 Drawing Sheets

METHODS AND PRODUCTS FOR IN VITRO GENOTYPING

RELATED APPLICATIONS

This application is a continuation in part of U.S. patent application Ser. No. 11/813,646, filed 10 Jul. 2007, now U.S. Pat. No. 7,914,990, issued Mar. 29, 2011, which is the national stage of PCT/IB06/00796 filed 12 Jan., 2006, and is related to: Spanish patent application P200500089 filed 13 Jan. 2005; Spanish patent application P200502423 filed 5 Oct. 2005; U.S. Provisional Application filed Jan. 12, 2006 by Simón Buela et al titled "MÉTODOS Y PRODUCTOS PARA GENOTIPADO IN VITRO", U.S. Ser. No. 60/758,192, the contents of all of which are incorporated herein by reference in their entirety.

FIELD OF THE INVENTION

The invention relates to methods and products for in vitro genotyping by analysis of biological samples. In particular the invention relates to DNA-chips and beads and the use of the chips and beads to detect genetic variations, e.g., polymorphisms or genetic mutations associated with disease, or connected to genotyping of antigens of interest, or associated with resistance to pharmaceutical treatment. The invention further relates to methods for analyzing data and to computer software based on the methods.

BACKGROUND OF THE INVENTION

In 2001, the Consortium for the Human Genome Project and the private company Celera presented the first complete example of the human genome with 30,000 genes. From this moment on, the possibility of studying the complete genome or large scale (high-throughput) studies began. DNA probe arrays such as DNA-chips or probe-coupled particle suspensions are apparatus that functional genomics can use for large scale studies. Functional genomics studies changes in the expression of genes due to environmental factors and to genetic characteristics of an individual. Gene sequences present small interindividual variations at one unique nucleotide called an SNP ("single nucleotide polymorphism"), which in a small percentage are involved in changes in the expression and/or function of genes that cause certain pathologies. The majority of studies which apply DNA-arrays or suspensions study gene expression, although DNA-arrays and suspensions are also used in the detection of SNPs.

In general, a DNA-chip comprises a solid support, which contains hundreds of fragments of sequences of different genes represented in the form of DNA, cDNA or fixed oligonucleotides, attached to the solid surface in fixed positions. The supports are generally glass slides for the microscope, nylon membranes or silicon "chips". It is important that the nucleotide sequences or probes are attached to the support in fixed positions as the robotized localization of each probe determines the gene whose expression is being measured. DNA-chips can be classified as:

high density DNA-chips: the oligonucleotides found on the surface of the support, e.g. glass slides, have been synthesized "in situ", by a method called photolithography.

low density DNA-chips: the oligonucleotides, cDNA or PCR amplification fragments are deposited in the form of nanodrops on the surface of the support, e.g. glass, by means of a robot that prints those DNA sequences on the support. There are very few examples of low density DNA-chips which exist: a DNA-chip to detect 5 mutations in the tyrosinase gene; a DNA-chip to detect mutations in p53 and k-ras; a DNA-chip to detect 12 mutations which cause hypertrophic cardiomypathy; a DNA-chip for genotyping of *Escherichia coli* strains; or DNA-chips to detect pathogens such as *Cryptosporidium parvum* or rotavirus.

For genetic expression studies, probes deposited on the solid surface, e.g. glass, are hybridized to cDNAs synthesized from mRNAs extracted from a given sample. In general the cDNA has been labelled with a fluorophore. The larger the number of cDNA molecules joined to their complementary sequence in the DNA-chip, the greater the intensity of the signal detected (e.g. a fluorescent signal), typically measured with a laser. This measure is therefore a reflection of the number of mRNA molecules in the analyzed sample and consequently, a reflection of the level of expression of each gene represented in the DNA-chip.

Gene expression DNA-arrays and suspensions typically also contain probes for detection of expression of control genes, often referred to as "house-keeping genes", which allow experimental results to be standardized and multiple experiments to be compared in a quantitative manner. With the DNA-array, the levels of expression of hundreds or thousands of genes in one cell can be determined in one single experiment. cDNA of a test sample and that of a control sample can be labelled with two different fluorophores so that the same DNA-array can be used to study differences in gene expression.

DNA-chips for detection of genetic polymorphisms, changes or mutations (in general, genetic variations) in the DNA sequence, comprise a solid surface, typically glass, on which a high number of genetic sequences are deposited (the probes), complementary to the genetic variations to be studied. Using standard robotic printers to apply probes to the array a high density of individual probe features can be obtained, for example probe densities of 600 features per $cm^2$ or more can be typically achieved. The positioning of probes on an array is precisely controlled by the printing device (robot, inkjet printer, photolithographic mask etc) and probes are aligned in a grid. The organisation of probes on the array facilitates the subsequent identification of specific probe-target interactions. Additionally it is common, but not necessary to divide the array features into smaller sectors, also grid-shaped, that are subsequently referred to as sub-arrays. Sub-arrays typically comprise 32 individual probe features although lower (e.g. 16) or higher (e.g. 64 or more) features can comprise each subarray.

One strategy used to detect genetic variations involves hybridization to sequences which specifically recognize the normal and the mutant allele in a fragment of DNA derived from a test sample. Typically, the fragment has been amplified, e.g. by using the polymerase chain reaction (PCR), and labelled e.g. with a fluorescent molecule. A laser can be used to detect bound labelled fragments on the chip and thus an individual who is homozygous for the normal allele can be specifically distinguished from heterozygous individuals (in the case of autosomal dominant conditions then these individuals are referred to as carriers) or those who are homozygous for the mutant allele.

Another strategy to detect genetic variations comprises carrying out an amplification reaction or extension reaction on the DNA-chip itself.

For differential hybridisation based methods there are a number of methods for analysing hybridization data for genotyping:

Increase in hybridization level: The hybridization level of complementary probes to the normal and mutant alleles are compared.

Decrease in hybridization level: Differences in the sequence between a control sample and a test sample can be identified by a fall in the hybridization level of the totally complementary oligonucleotides with a reference sequence. A complete loss is produced in mutant homozygous individuals while there is only 50% loss in heterozygotes. In DNA-chips for examining all the bases of a sequence of "n" nucleotides ("oligonucleotide") of length in both strands, a minimum of "2n" oligonucleotides that overlap with the previous oligonucleotide in all the sequence except in the nucleotide are necessary. Typically the size of the oligonucleotides is about 25 nucleotides. The increased number of oligonucleotides used to reconstruct the sequence reduces errors derived from fluctuation of the hybridization level. However, the exact change in sequence cannot be identified with this method; sequencing is later necessary in order to identify the mutation.

Where amplification or extension is carried out on the DNA-chip itself, three methods are presented by way of example:

In the Minisequencing strategy, a mutation specific primer is fixed on the slide and after an extension reaction with fluorescent dideoxynucleotides, the image of the DNA-chip is captured with a scanner.

In the Primer extension strategy, two oligonucleotides are designed for detection of the wild type and mutant sequences respectively. The extension reaction is subsequently carried out with one fluorescently labelled nucleotide and the remaining nucleotides unlabelled. In either case the starting material can be either an RNA sample or a DNA product amplified by PCR.

In the Tag arrays strategy, an extension reaction is carried out in solution with specific primers, which carry a determined 5' sequence or "tag". The use of DNA-chips with oligonucleotides complementary to these sequences or "tags" allows the capture of the resultant products of the extension. Examples of this include the high density DNA-chip "Flex-flex" (Affymetrix).

For genetic diagnosis, simplicity must be taken into account. The need for amplification and purification reactions presents disadvantages for the on-chip extension/amplification methods compared to the differential hybridization based methods.

Typically, DNA-array analysis is carried out using differential hybridization techniques. However, differential hybridization does not produce as high specificity or sensitivity as methods associated with amplification on glass slides. For this reason mathematical algorithms, which increase specificity and sensitivity of the hybridization methodology, have been developed. See co-pending patent application U.S. Ser. No. 11/813,646, filed 12 Jan. 2006. The problems of existing DNA-arrays in simultaneously detecting the presence or absence of a high number of genetic variations in a sensitive, specific and reproducible manner has prevented the application of DNA-arrays for routine use in clinical diagnosis of human disease. The inventors have developed a sequential method of processing and interpreting the experimental data generated by genotyping DNA-chips based on an increase in hybridization signal. The method produces high levels of specificity, sensitivity and reproducibility, which allow the DNA-arrays developed on the basis of this method to be used for example, for reliable clinical genetic diagnosis.

SUMMARY OF THE INVENTION

The present inventors have developed a sensitive, specific and reproducible method for simultaneously detecting and characterising genetic variations which is useful for the development of products for genotyping. The method relates to an original trial design for genotyping using particle suspensions and the use of a sequential system (algorithm) for processing and interpreting the trial data generated by the particle suspensions (based on an increase in hybridization signal), which guarantees high levels of specificity, sensitivity and reproducibility of results and in turn allows the particle suspensions to be used, for example, as reliable apparatus in clinical genetic diagnosis.

In one aspect, the invention provides an vitro method for genotyping genetic variations in an individual, the method comprising providing a sample containing nucleic acid which comprises the genetic variations to be genotyped (the target DNA), providing, for each genetic variation to be genotyped, oligonucleotide probe pairs, wherein one probe in each pair being capable of hybridising to genetic variation A and the other probe in each pair being capable of hybridising to genetic variation B, wherein each probe is provided in replicates and the probe replicates are each coupled to a solid support, amplifying and detectably labelling the target DNA, contacting the target DNA with the probes under conditions which allow hybridisation to occur, thereby forming detectably labeled nucleic acid-probe hybridisation complexes, determining the intensity of detectable label for each probe, thereby obtaining a raw intensity value for each particle type, optionally amending the raw intensity value to take account of background noise, thereby obtaining a clean intensity value for each replica; and applying a suitable algorithm to the aforementioned intensity data thereby determining the genotype with respect to each genetic variation, wherein application of the algorithm comprises calculating a median intensity value from the intensity values for each of the replicas of each probe coupled with a particle, and wherein the algorithm uses three linear functions that characterizes each of the three possible genotypes AA, AB or BB for the genetic variation. In some embodiments, the solid support is a particle (e.g., a particle in suspension) and accordingly all the probes are supported on a plurality of particles.

In some embodiments the particles are nanoparticles, microparticles, or a combination thereof. In some embodiments the particles are in a suspension buffer. In some embodiments, the genetic variations comprise single nucleotide polymorphisms (SNPs), insertions, deletions, or gene rearrangements. In some embodiments, the genetic variations are associated with IBD, erythrocyte and human platelet antigens, Multiple Sclerosis, Rheumatoid Arthritis, Prostate Cancer, Osteoporosis, Familial Hypercholesterolemia, or adverse reactions to pharmaceuticals.

In one embodiment, the amplification is carried out using the polymerase chain reaction (PCR). In another embodiment, the method comprises use of the PCR primers in SEQ ID NOS 1457-1458. In still another embodiment, the method further comprises fragmentation of the amplified products.

In one embodiment, the products are biotinylated during the PCR process by inclusion of a biotinylated nucleotide. In another embodiment the detectable label is chosen from the group comprising a fluorescent label, a radioactive label, or a chemical label. In a further embodiment the detectable label is a streptavidin-phycoerthrine conjugate.

In one embodiment, the method further comprises extracting the nucleic acid from a biological sample obtained from an individual. In some embodiments the nucleic acid extracted from the sample is DNA or RNA. In another embodiment the method further comprises producing cDNA from extracted RNA.

In one embodiment, the intensities of detectable label and the type of particle is determined using a flow cytometer. In another embodiment the particles comprise particle types with different known fluorescent light absorbance intensities. In one embodiment each probe is attached to a uniquely identifiable type of particle. In one embodiment the method of calculating the raw intensity value for each probe comprises eliminating outlying intensity values.

In one embodiment the algorithm is based on three Linear Functions, which characterize each of the three possible genotypes:

AA a1ratio1+b1ratio2+c1 Function 1
AB a2ratio1+b2ratio2+c2 Function 2
BB a3ratio1+b3ratio2+c3 Function 3
Wherein
 AA represents the genotype of a homozygote subject for the allelic variant 1 (allele 1);
 AB represents the genotype of a heterozygote subject for the allelic variants 1 and 2 (allele 1 and allele 2);
 BB represents the genotype of a homozygote subject for the allelic variant 2 (allele 2);
 a1 is the coefficient which accompanies the X in the Linear Function for the genotype AA; this variable is obtained by applying the discriminate analysis to the ratios 1 and 2 obtained from analysing Z patients for the genotype AA, Z for BB and Z for AB,
wherein Z is a number more than two,
 b1 is the coefficient which accompanies the Y in the Linear Function for the genotype AA; this variable is obtained by applying the discriminate analysis to the ratios 1 and 2 obtained from analysing Z patients for the genotype AA, Z for BB and Z for AB;
 c1 is the independent term of the first Linear Function;
 a2 is the coefficient which accompanies the X in the Linear Function for the genotype AB; this variable is obtained by applying the discriminate analysis to the ratios 1 and 2 obtained from analysing Z patients for the genotype AA, Z for BB and Z for AB;
 b2 is the coefficient which accompanies the Y in the Linear Function for the genotype AB; this variable is obtained by applying the discriminate analysis to the ratios 1 and 2 obtained from analysing Z patients for the genotype AA, Z for BB and Z for AB;
 c2 is the independent term of the second Linear Function;
 a3 is the coefficient which accompanies the X in the Linear Function for the genotype BB; this variable is obtained by applying the discriminate analysis to the ratios 1 and 2 obtained from analysing Z patients for the genotype AA, Z for BB and Z for AB;
 b3 is the coefficient which accompanies the Y in the Linear Function for the genotype BB; this variable is obtained by applying the discriminate analysis to the ratios 1 and 2 obtained from analysing Z patients for the genotype AA, Z for BB and Z for AB;
 c3 is the independent term of the third Linear Function;
 Function 1 is the Linear Function, which s patients with genotype AA; this function is obtained the same as 2 and 3 when discriminate analysis is applied to the discrimination of Z patients AA, Z BB and Z AB whose ratios 1 and 2 are known;

One probe is used for each allele, comprising probes 1 and 2 (oligo 1 and oligo 2), wherein probe 1 corresponds to allele one and probe 2 corresponds to allele two;
 Function 2 is the Linear Function for genotype AB;
 Function 3 is the Linear Function for genotype BB;
 Ratio 1 is the proportion of the median of the intensities of the particles of the same type linked to oligo 1 which detects the allele one divided by the median of the intensities of the oligo 1 plus the median of the intensities of intensities of the particles of the same type linked to oligo 2 and can be calculated by the equation:

$$\text{Ratio } 1 = \frac{\text{Median oligo intensity oligo 1}}{\text{Median oligo intensity oligo 1} + \text{Median oligo intensity oligo 2}}$$

and
 Ratio 2 is the proportion of the median of the intensities of the particles of the same type linked to oligo 2 which detects the allele two divided by the median of the intensities of the oligo 1 plus the median of the intensities of intensities of the particles of the same type linked to oligo 2 and can be calculated by the equation:

$$\text{Ratio } 2 = \frac{\text{Median oligo intensity oligo 2}}{\text{Median oligo intensity oligo 1} + \text{Median oligo intensity oligo 2}}$$

In another embodiment, the algorithm is based on three Linear Functions, which characterize each of the three possible genotypes:

AA a1ratio1+b1ratio2+c1 Function 1
AB a2ratio1+b2ratio2+c2 Function 2
BB a3ratio1+b3ratio2+c3 Function 3
Wherein
 AA represents the genotype of a homozygote subject for the allelic variant 1 (allele 1);
 AB represents the genotype of a heterozygote subject for the allelic variants 1 and 2 (allele 1 and allele 2);
 BB represents the genotype of a homozygote subject for the allelic variant 2 (allele 2);
 a1 is the coefficient which accompanies the X in the Linear Function for the genotype AA; this variable is obtained by applying the discriminate analysis to the ratios 1 and 2 obtained from analysing Z patients for the genotype AA, Z for BB and Z for AB,
wherein Z is a number more than two,
 b1 is the coefficient which accompanies the Y in the Linear Function for the genotype AA; this variable is obtained by applying the discriminate analysis to the ratios 1 and 2 obtained from analysing Z patients for the genotype AA, Z for BB and Z for AB;
 c1 is the independent term of the first Linear Function;
 a2 is the coefficient which accompanies the X in the Linear Function for the genotype AB; this variable is obtained by applying the discriminate analysis to the ratios 1 and 2 obtained from analysing Z patients for the genotype AA, Z for BB and Z for AB;
 b2 is the coefficient which accompanies the Y in the Linear Function for the genotype AB; this variable is obtained by applying the discriminate analysis to the ratios 1 and 2 obtained from analysing Z patients for the genotype AA, Z for BB and Z for AB;

c2 is the independent term of the second Linear Function;

a3 is the coefficient which accompanies the X in the Linear Function for the genotype BB; this variable is obtained by applying the discriminate analysis to the ratios 1 and 2 obtained from analysing Z patients for the genotype AA, Z for BB and Z for AB;

b3 is the coefficient which accompanies the Y in the Linear Function for the genotype BB; this variable is obtained by applying the discriminate analysis to the ratios 1 and 2 obtained from analysing Z patients for the genotype AA, Z for BB and Z for AB;

c3 is the independent term of the third Linear Function;

Function 1 is the Linear Function, which s patients with genotype AA; this function is obtained the same as 2 and 3 when discriminate analysis is applied to the discrimination of Z patients AA, Z BB and Z AB whose ratios 1 and 2 are known;

Two probes are used for each allele, comprising probes 1 2, 3 and 4, wherein probe 1 corresponds to allele 1, probe 2 corresponds to allele 2, probe 3 corresponds to allele 1, and probe 4 corresponds to allele 2;

Function 2 is the Linear Function for genotype AB;

Function 3 is the Linear Function for genotype BB;

Ratio 1 is the proportion of the median of the intensities of the particles of the same type linked to oligo 1 which detects the allele one divided by the median of the intensities of the oligo 1 plus the median of the intensities of intensities of the particles of the same type linked to oligo 2 and can be calculated by the equation:

$$\text{Ratio } 1 = \frac{\text{Median oligo intensity oligo 1}}{\text{Median oligo intensity oligo 1 + Median oligo intensity oligo 2}}$$

and

Ratio 2 is the proportion of the median of the intensities of the particles of the same type linked to oligo 3 which detects the allele one divided by the median of the intensities of the oligo 3 plus the median of the intensities of intensities of the particles of the same type linked to oligo 4 and can be calculated by the equation:

$$\text{Ratio } 2 = \frac{\text{Median oligo intensity oligo 3}}{\text{Median oligo intensity oligo 3 + Median oligo intensity oligo 4}}$$

In one embodiment, Z is 10. In another embodiment the genotyping of said allelic variants comprises grouping the corresponding intensities data of each type of oligonucleotide coupled with the a uniquely identifiable type of particle which has been used to characterize each mutation, calculating the median intensity value for each one of the 2 or 4 oligonucleotides coupled using the intensities of the particles coupled with each different oligonucleotide in order to eliminate outliers, calculating ratios 1 and 2 for each; and determining genotype of the patient.

In one embodiment the method further comprising predicting a phenotype in a subject, wherein the predicting a phenotype in a subject comprises analysis of a plurality of genetic variations in order to determine a haplotype and make an allele call, and using the allele call to predict the phenotype. In one embodiment the analysis of the genetic variations further comprises software to complete the analysis.

In one embodiment, wherein the particles are cylindrical microparticles encoded with a barcode, and wherein the barcode is read by a barcode scanner. In one embodiment, the linear function is a Fisher linear function. In another embodiment, the raw intensity value is a median intensity value.

DETAILED DESCRIPTION

Figure 1:
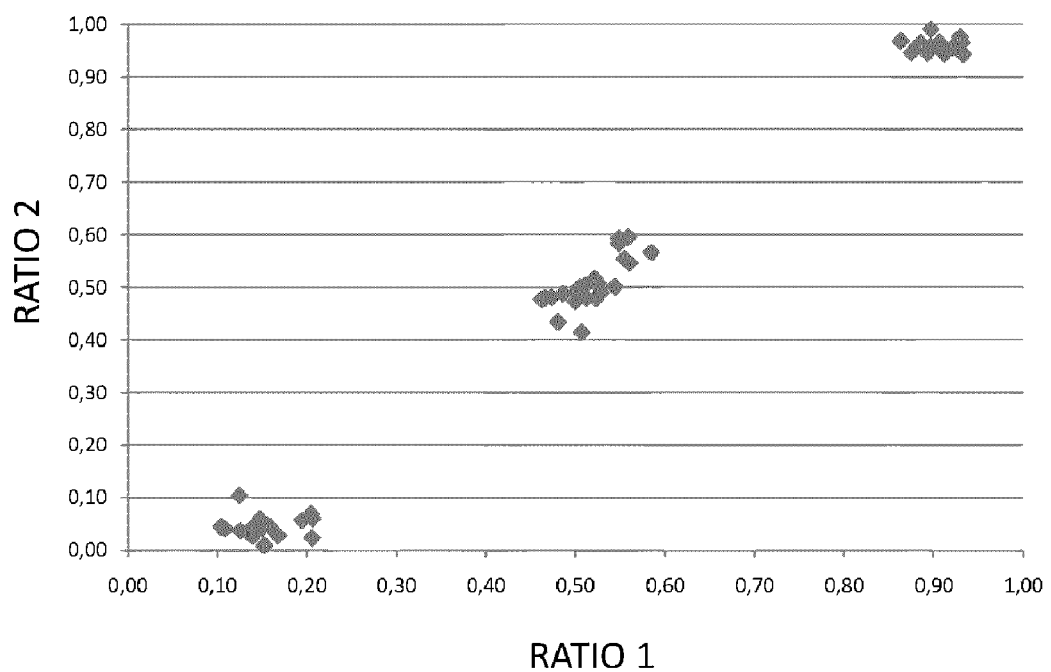
FIG. 1 shows the representation of ratios 1 and 2 and allows characterization of 54 individual blood donors.

The present invention relates to a method of genotyping genetic variations in an individual, which is sufficiently sensitive, specific and reproducible as to allow its use in a clinical setting. The inventors have developed DNA-arrays and particle suspensions with specifically designed probes for use in the method, and a computational method or algorithm for interpreting and processing the data generated by the arrays or suspensions. As used herein, the term array refers to a planar array such as a chip, wherein the probes are immobilized at known locations on a planar solid support. Alternatively, the probes may be in a particle suspension, wherein each probe is attached to an identifiable particle. Thus in one aspect, the invention comprises an in vitro method for genotyping genetic variations in an individual. The in vitro, extracorporeal method is for simultaneous sensitive, specific and reproducible genotyping of multiple human genetic variations present in one or more genes of a subject. The method of the invention allows identification of nucleotide changes, such as, insertions, duplications and deletions and the determination of the genotype of a subject for a given genetic variation.

The terms "genetic variation" or "genetic variant", as they are used in the present description include mutations, polymorphisms and allelic variants. A variation or genetic variant is found amongst individuals within the population and amongst populations within the species.

The term "polymorphism" refers to a variation in the sequence of nucleotides of nucleic acid where every possible sequence is present in a proportion of equal to or greater than 1% of a population; in a particular case, when the said variation occurs in just one nucleotide (A, C, T or G) it is called a single nucleotide polymorphism (SNP).

The term "genetic mutation" refers to a variation in the sequence of nucleotides in a nucleic acid where every possible sequence is present in less than 1% of a population The terms "allelic variant" or "allele" are used without distinction in the present description and refer to a polymorphism or set of polymorphisms that appear(s) in the same locus in the same population.

The term "haplotype" in the context of the instant invention refers to a plurality of polymorphisms within a genetic segment that are statistically associated. According to the methods of the invention, determination of a haplotype can enable identification of an allele for a given DNA sample.

Thus a genetic variation may comprise a deletion, substitution or insertion of one or more nucleotides. In one aspect the genetic variations to be genotyped according to the present methods comprise SNPs.

A given gene may comprise one or more genetic variations, such as SNPs, insertions, deletions, or gene rearrangements. Thus the present methods may be used for genotyping of one or more genetic variations in one gene, or more than one gene. In some aspects of the invention it is advantageous using the methods of the invention to determine the SNP haplotype associated with the condition being investigated in order to identify the allele of the subject. For many genes a particular known combination of SNPs, insertions, deletions, or gene rearrangements (a "haplotype") is known to be indicative of gene function (or lack thereof) and can therefore be used for prognosing phenotype. Allele identification can be especially useful, for example, in cases where no family information is available to enable prognosis using a single SNP.

Typically the individual is a human.

Typically, for a given genetic variation there are three possible genotypes:

AA the individual is homozygous for genetic variation A (e.g homozygous for a wild type allele)

BB the individual is homozygous for genetic variation B (e.g. homozygous for a mutant allele)

AB the individual is heterozygous for genetic variations A and B (e.g. one wild type and one mutant allele)

In one aspect the genetic variations, such as SNPs, to be analysed according to the present methods, are associated with a particular phenotype or disease condition. For example, the variations may be associated with particular erythrocyte or human platelet antigens (and thus often a particular blood group). These genetic variations can also be used to diagnose or prognose human disease conditions. Such conditions include, but are not limited to, Multiple Sclerosis (MS), Inflammatory Bowel Disease (IBD), familial hypercholesterolemia (FH); Rheumatoid Arthritis (RA), Osteoporosis, or various cancers, or with adverse reactions to pharmaceuticals in an individual.

Examples of genetic variations associated with IBD which may be assessed by the present methods include those in Table 1 below.

Inflammatory Bowel Disease

Inflammatory Bowel Disease (IBD) is characterized by chronic inflammation of the intestine. This pathology presents two clinical forms, Crohns Disease (CD) and Ulcerative Colitis (UC). CD can affect any area of the intestinal tract and is associated with irregular internal injuries of the intestinal wall, while in the case of UC the inflammation is limited to the rectum and colonic mucosa and the injuries are continuous and superficial. The annual rate of UC and CD in Spain is from 4 to 5 and from 1.8 to 2.5 cases per 100,000 people, respectively. In the United States the prevalence of these diseases can reach numbers of 200 to 300 in every 100,000. The disease has a severe effect on quality of life, in particular given its chronic progress, evolution in outbreaks and frequent need for surgery. Patients of both suffer inflammation of the skin, eyes and joints.

Treatments for IBD include immunosuppressants, anti-inflammatory agents, such as antibodies targeted against tumor necrosis factor α (TNF-α) and surgery. The molecular biology of the pathogenesis of IBD is still not clear, but causative factors appear to include bacterial infection in the intestinal wall and an imbalance in the regulation of the bowel immune response.

CD and UC are classified as autoimmune diseases, both being more prevalent in individuals who have previously had another autoimmune condition. There is a predominance of CD in the female population and of UC in the male, predominantly in the older age bracket with distal proctitis or colitis.

Epidemiologic and genetic studies have provided evidence of the presence of genetic susceptibility factors for IBD, increasing expectations that the identification of genes related to IBD could bring a better understanding of the pathogenesis, diagnosis, location, and prognosis and appropriate treatment. Starting from informal studies to evaluate the risk of contracting the disease, such as segregation analysis, evidence has been provided of a genetic origin. Between 10-20% of the relatives of patients affected by CD or UC also suffered from these diseases. However, the tendency to CD and UC is complex and includes various genes as well as environmental factors. IBD is considered to be a complex genetic disease in which inheritance is not considered to be a simple Mendelian trait. Numerous studies of the association between genome and disease susceptibility have recently identified several genes in which one or more genetic variations results in a higher or lower risk of contracting the disease, a better or worse response to drugs or a better or worse prognosis.

For this reason, the clinical application of a DNA array or particle suspension to characterize the genetic variations associated with IBD will provide benefits for diagnosis and treatment. From a clinical point of view, the early diagnosis, prognosis and location of the disease would influence therapeutic decisions as to treatment of IBD. At least two different groups would benefit from this development:

relatives of IBD patients who are interested in knowing their likelihood of developing the disease; and patients who have IBD, in order to be able to choose a personalised therapy, depending on the risk of inflammation or fistulae. The higher the risk of contracting a severe form of IBD, the greater the need for more aggressive therapy.

Apart from the contribution to diagnosis and treatment of IBD and the development of new therapeutic strategies, progress in the physiopathology of the inflammatory reaction in IBD will also be of interest in the study of a wide range of autoimmune diseases including several neurodegenerative diseases, rheumatoid arthritis and dermatological conditions such as psoriasis.

A DNA array or particle suspension, which allows the simultaneous, sensitive, specific and reproducible detection of genetic variations associated with IBD, could be used clinically in diagnosing IBD. Some non-limiting examples of genetic variations associated with IBD for use in the methods of the invention are listed below.

TABLE 1

Genetic variations associated with IBD

The polymorphism G2677T/A/C Ala893Ser/Thr/Pro of the gene Multidrug resistance protein 1(MDR1);
The polymorphism C3435T of the gene Multidrug resistance protein 1(MDR1);
The polymorphisms R702W, G908R, 1007insC in the gene Caspase recruitment domain-containing protein 15 (CARD15);
The polymorphism T612C Y113H in the gene Microsomal epoxide hydrolase (EPXH1);
The polymorphism (−2518)G/A of the gene Monocyte chemotactic protein 1 (MCP1);
The polymorphisms (−1082) G/A and G43A (G15R) in the gene Interleukin 10 (IL10);
The polymorphism (−295)T/C in the gene Interleukin 16 (IL16);
The polymorphism (−843)C/T in the gene Fas ligand;
The polymorphisms 94delATTG and −263A/G in the gene Nuclear factor kappa-B 1(NFKB1);

TABLE 1-continued

Genetic variations associated with IBD

The polymorphism in 3'UTR (G/A) of the gene Nuclear factor kappa-B inhibitor alpha (NFKBIA);
The polymorphism G2964A in the gene Signal transducer and activator of transcription 6 (STAT6);
The polymorphism TCA/TCC of codon 35 in the gene Interleukin 18 (IL18);
The polymorphisms E474E, Q476Q, D510D, P588P, −177A/G, A165A, R202Q in the gene Mediterranean fever gene (MEFV);
The polymorphism 113G/A (R30Q) in the gene Discslarge, *Drosophila*, homolog of, 5 (DLG5);
The polymorphism A2033T in the gene Colony stimulating factor receptor 1 (CSFR1);
The polymorphism 1672C/T (L503F) in the gene Organic cation transporter (OCTN1, SLC22A4);
The polymorphism (−207G/C) in the Organic cation transporter (OCTN2, SLC22A5);
The polymorphisms Asp299Gly and Thr399Ile in the gene Toll-like receptor 4 (TLR4);
The polymorphisms (−511)A/C and 3954 TaqI RFLP in the gene Interleukin 1 beta (IL1β);
The polymorphism Ala16Val in the gene Superoxide dismutase 2 (SOD2);
The polymorphism Pro12Ala in the gene Peroxisome proliferator-activated receptor gamma (PPARG);
The polymorphisms K469E, R241G in the gene Intercellular adhesion molecule 1 (ICAM1);
The polymorphisms IGR2060a_1, IGR2198a_1, IGR3096a_1 in the locus Inflammatory Bowel Disease 5 (IBD5);
The polymorphism 1267A/G (Gln351Gln) in the gene Heat shock protein 70 (HSP70-2);
The polymorphism 1237C/T in the gene Toll-like receptor 9 (TLR9);
The polymorphism C677T (V222A) in the gene Methylinetetrahydrofolate reductase (MTFHR);
The polymorphisms (−590)C/T, (−34)C/T in the gene Interleukin 4 (IL4);
The polymorphisms Gly54Asp (A/G), Gly57Glu (A/G), Arg52Cys (C/T) in the gene Mannose-binding lectin (MBL);
The polymorphism (−6) A/T in the gene Angiotensinogen precursor (AGT);
The polymorphism 4G/5G in the gene Plasminogen activator inhibitor (PAI);
The polymorphisms (−857C/T), (−308G/A), (−238 G/A) in the gene Tumor necrosis factor alpha (TNF-α);
The polymorphisms G238C, G460A, A719G in the gene TPMT;
The polymorphisms Trp14Gly, Thr24Ala, Met129Val, Lys173Glu, Gly175Ser of the gene Major histocompatibility complex class I chain-realted-gene A (MICA) that discriminates the alleles MICA*007 and MICA*008;
The polymorphism of the promoter region (−377 to −222) characteristic of allele 7 of the gene Solute carrier family 11, member 1 (SLC11A1 = NRAMP1);
The polymorphism (−159)T/C of the gene CD14;
The polymorphism G4985T (Val158Phe) of the gene CD16A = FCGR3A;
The polymorphism −25385C/T of the gene Nuclear receptor subfamily 1, group I, member 2 (NR1I2);
The polymorphism (T/A) (Cys10Stop) of the gene Caspase recruitment domain-containing protein 8 (TUCAN/CARD8/CARDINAL);
The polymorphism 738T/C (Cys224Arg) of the gene Inhibitor of kappa light chain gene enhancer in B cells-like (IKBL);
The polymorphisms G593A and T620C of the gene Tumor necrosis factor receptor subfamily, member 1B (TNFRSF1B = TNFR2);
The polymorphism Asp643Asn of the gene Mitogen-Activated kinase kinase kinase 1 (MEKK1);
The polymorphisms 159G/A/C and 282C/T of the gene Major Histocompatibility complex, class II, DQ Alpha-1 (HLA-DQ) for the identification of the alleles DQB1*0401 and DQB1*0402;
The polymorphisms 109T/C, 119T/C/G/A, 122A/C/G/T, 129A/G, 161G/A/T, 175A/T/C/G, 184A/C/delA, 286C/A/T, 305C/G for the identification of alleles DR2, DR9, DRB1*0103, DR4, DR7, DRB3*0301 and DR3 of the gene Major histocompatibility complex, class II, DR Beta-1 (HLA-DRB1);
The polymorphisms 2018T/C and 2073C/T of the gene Interleukin 1 receptor antagonist (IL1RN);
The polymorphism 3954 C/T (TAQI) of the gene Interleukin 1 receptor, type II (IL1RB);
The polymorphism (−670) G/A of the gene Fas Antigen;
The polymorphism 93 C/T of the gene Caspase 9 (CASP9);
The polymorphism G/C (R80T) of the gene Toll-like receptor 1 (TLR1);
The polymorphism A/G (R753G) of the gene Toll-like receptor 2 (TLR2);
The polymorphism T/C (S249P) of the gene Toll-like receptor 6 (TLR6);
The polymorphism 5A/6A of the gene Matrix metalloproteinase 3 (MMP3);
The polymorphism indel +32656 of the gene NOD-1 protein (NOD1 = CARD4);
The polymorphism DLG5_e26 in the gene Discslarge, *Drosophila*, homolog of, 5 (DLG5);
The polymorphism with rs20752817 of the gene NOD-1 protein (NOD1 = CARD4);
The polymorphism with rs2975632 of the gene NOD-1 protein (NOD1 = CARD4);
The polymorphism with rs3020207 of the gene NOD-1 protein (NOD1 = CARD4);
The polymorphism with rs2075818 of the gene NOD-1 protein (NOD1 = CARD4);
The polymorphism with rs2235099 of the gene NOD-1 protein (NOD1 = CARD4);
The polymorphism with rs2075821 of the gene NOD-1 protein (NOD1 = CARD4);
The polymorphism with rs2075822 of the gene NOD-1 protein (NOD1 = CARD4);
The polymorphism with rs2907748 of the gene NOD-1 protein (NOD1 = CARD4);
The polymorphism with rs5743368 of the gene NOD-1 protein (NOD1 = CARD4);
The polymorphism with rs2289311 of the gene NOD-1 protein (NOD1 = CARD4);
The polymorphism A1298C in the gene Methylinetetrahydrofolate reductase (MTFHR);
The polymorphism Ile114Thr in the gene N-Acetyl tranferase 2(NAT2);
The polymorphism (A/G) Lys268Arg in the gene N-Acetyl tranferase 2(NAT2);
The polymorphism with rs9340799 of the gene Estrogen receptor 1 (ESR1);
The polymorphism with rs2234693 of the gene Estrogen receptor 1 (ESR1);
The polymorphism C/T V726A in the gene Mediterranean fever gene (MEFV);
The polymorphism with rs10735810 in the Vitamin D receptor (VDR);
The polymorphism (C/G)E127Q in EGF-like module-continuing, mucin-like hormone receptor 3 (EMR3);
The polymorphism (G/T)Q496K in EGF-like module-continuing, mucin-like hormone receptor 1 (EMR3);
The polymorphism R653Q in the Methylenetetrahydrofate dehydrogenase 1 (MTHFD1);
The polymorphism 1420 (C/T) in the Serine hydroxymethyltransferase (SHMT1);
The polymorphism Gly286Glu in the gene N-Acetyl tranferase 2(NAT2);

TABLE 1-continued

Genetic variations associated with IBD

The polymorphism Arg197Gln in the gene N-Acetyl tranferase 2(NAT2);
The polymorphism 191 (G/A) in the gene N-Acetyl tranferase 2(NAT2);
The polymorphism Arg392Stop of the gene Toll-like receptor 5 (TLR5);
The polymorphism A49G of the gene cytotoxic T lymphocyte-associated 4 (CTLA4);
The polymorphism D132H of the gene MutL, E. coli, homolog of, 1 (MLH1);
The polymorphism 66A/G of the gene Methionine synthase reductase (MTRR);
The polymorphism 94C/A of the gene Inosine Triphosphatase (ITPA);
The polymorphism E148Q in the gene Mediterranean fever gene (MEFV);
The polymorphism R620W in the protein tyrosine phosphatase, nonreceptor-type, 22 (PTPN22);
The polymorphism 3357 A/G in the Low density lipoprotein receptor-related protein 5 (LRP-5);
The polymorphism C318T of the gene cytotoxic T lymphocyte-associated 4 (CTLA4);
The polymorphism rs333 32bpdel of the gene chemokine, CC motif, receptor 5(CCR5);
The polymorphism −174G/C of the gene interleukin-6(IL6);
The polymorphism with rs6190 of the gene glucocorticoid receptor (GR ER22/23EK);
The polymorphism Arg72Pro of the gene p53;
The polymorphism P1371Q in the gene Discslarge, Drosophila, homolog of, 5 (DLG5);
The polymorphism with rs6189 of the gene glucocorticoid receptor (GR ER22/23EK);
The polymorphism C135242T in the Low density lipoprotein receptor-related protein 5 (LRP-5);
The polymorphism G121513A in the gene Low density lipoprotein receptor-related protein 5 (LRP-5);
The polymorphism C141759T in the gene Low density lipoprotein receptor-related protein 5 (LRP-5);
The polymorphism G138351A in the gene Low density lipoprotein receptor-related protein 5 (LRP-5);
The polymorphism (−298) C/T in the gene Purinergic receptor P2X, ligand-gated ion channel, 7 (P2RX7);
The polymorphism (−838) G/T in the gene Purinergic receptor P2X, ligand-gated ion channel, 7 (P2RX7);
The polymorphism E1317Q in the gene Adenomatous polyposis of the colon (APC);
And the polymorphism T64C in the gene CD97 (CD97);

Erythrocyte Antigens

The blood of each person is so characteristic that it can serve as a means of identification that is nearly as precise as fingerprints; only identical twins have exactly the same blood characteristics. Blood group determination is particularly useful in medical fields such as blood transfusions, haemolytic diseases in foetuses and the new born, medical-legal applications and organ transplantation.

The majority of transfusions can be considered safe. However, sometimes they produce slight reactions or possibly a serious and even fatal reaction. Temperature and allergic (hypersensitivity) reactions, occur in 1-2% of transfusions, but more serious incompatibilities do exist which cause the destruction of red cells, (a haemolytic intravascular reaction).

Foetal and new born haemolytic disease (HDNF) is a well known immunological condition, in which the potential for survival of the foetus or new born is compromised due to the action of maternal antibodies that pass through the placenta and specifically target antigens of paternal origin present in the red cells of the foetus or new born. It has been determined that EHPN is not only due to antibodies against the D antigen, but that antigens of the RH system, the ABO system and others are also involved.

Correct genotyping of blood groups therefore has importance in transfusions (including the detection of rare or infrequent alleles).

Blood groups are composed of alloantigens present on the surface of the erythrocyte membrane and red cells, which are transmitted from parents to children according to the laws of Mendelian genetics.

The International Society of Blood Transfusions has classified more than 26 different human blood groups. The majority have been defined at a genetic level and include polymorphisms at one unique nucleotide (SNPs), genetic deletions, conversions and other events, which result in genetic variation. The blood group antigens can be classified in two large groups:

A. Antigens determined by carbohydrates.
B. Antigens determined by proteins.

A. Antigens Determined by Carbohydrates
Group ABO

This blood group is of clinical importance because it causes the majority of incompatibility reactions in transfusions and organ transplants. The biochemical basis of group ABO depends on the activity of an N-acetylgalactosamine transferase in individuals of blood group A and a galactosyl transferase in blood group B; whilst individuals belonging to group O lack an active transferase enzyme. The genetic basis of the ABO phenotypes is the substitution of amino acids in the ABO gene of glycosyltransferase. This gene is 19,514 bases in size and encodes a membrane bound enzyme that uses GalNAc or UDP-Gal as a substrate. Four amino acid changes in exons 6 and 7 of the ABO gene are responsible for substrate specificity of the transferases A and B respectively, within them the changes Gly235Ser and Leu266Met are vital. The majority of individuals of group O present deletion of one single nucleotide (A261G) which gives rise to a change in the reading frame and results in the production of an inactive transferase protein. Nonetheless, a growing number of O alleles (about 20) exist that result in nonexpression of the transferases A or B. Rare alleles of the subgroup ABO, like A3, Ax, Ael, B3Bx and Bel have been described. These alleles have arisen from genetic recombinations from different alleles of the ABO group.

B. Antigens Determined by Proteins.
B.1. Antigens Dependent on Expression of Erythrocyte Transferase Molecules.
Rh (RH)

Incompatibility of RH occurs in a large portion of transfusion reactions and is the main cause of hemolytic disease in newborn and fetuses (HDNF). The RH antigens come from two proteins (RH CcEe and RH D) encoded by the RH locus (1p34-36.2) that contains the genes RHD and RHCE (70 Kb). Possibly the positive D haplotypes present a configuration of the genes RHD-RHCE of the same orientation, while the negative D haplotypes present a reverse orientation. The negative D phenotype, common in old European populations, is caused by a deletion of the gene RHD. This seems to have been generated by an unequal crossing over between the genes RHCE and RHD. In the African population a pseudogene of RHD is the predominant D negative allele but its frequency diminishes amongst Afro-Americans and Afro- Caribbeans. Recombinations between the genes RHCE and RHD cause rare hybrids that lead to a partial expression of the D antigen. These uncommon antigens on some occasions have been identified as clinically significant.

The proteins RH CcEe and RH D co-express themselves with an equivalent glycoprotein (36% identity), the associated glycoprotein RH (RHAG). This erythrocyte specific complex is possibly a hetero tetramer implicated in bidirectional ammonia transport. The mutations in RHAG are the causes of RH null syndrome, associated with defects in transport across the erythrocyte membrane, deficiencies in CD47 and a total absence of ICAM-4. Furthermore, genes related to RHAG, RHBG and RHCG have been found in the regions 1q21.3 and 15q25 respectively. These genes are expressed in different forms in different human tissue.

Kidd (JK)

The Kidd (JK) antigens occur in the urea transporter hUT-B1 of red cells. The significance of the Kidd antigen has been known for two decades when it was discovered that JK (a⁻b⁻) red cells were resistant to lysis in 2M urea. The molecular basis of the expression of the Kidd antigen is a SNP in nucleotide 838 (G-A) causing a change Asp280Asn (JK*A-JK*B). The Kidd null phenotype, JK (a⁻b⁻) is due to mutations causing frame-shift mutations, premature termination of translation, inappropriate gene splicing and partial deletions in the gene SLC14A1.

Diego (DI)

The antigens of the blood group Diego (DI) are the most abundant proteins on the surface of red cells (1.1 million copies per cell), and are crucial for carrying $CO_2$ and acid-base homeostasis. It is thought that Di antigens vary due to multiple SNPs present in the gene SLC4A1.

Colton (CO)

The CO antigens (COa, COb and CO3) are expressed by the carrier molecule AQP-1. The (COa-COb) antigens are produced by a SNP in AQP-1 that produces a change in codon 45 from alanine to valine.

B.2 Antigens Determined by Expression of Red Cell Membrane Enzymes.

Kell (KEL)

The antigens of the KEL system are very important in transfusions; the k antigen is the second main cause of haemolytic disease in the new born. The glycoprotein KEL is a type II membrane protein. The C-terminal catalytic regions process large endothelins that are potent vasocontrictors. Cysteine 72 of the glycoprotein KEL forms a disulphide bridge with the protein Kx, which might explain why erythrocytes null for KEL (Ko) show activation of levels of the Kx antigen. The antigen of this system with most clinical importance, K (KEL1), is associated with a change Met193Thr that allows Asn-X.ThrN-glycosylation to occur.

Dombrock (DO)

The variants DOa/DOb are due to an SNP in the gene DOK1, which encodes an enzyme ADP ribosyltransferase, that affects codon 265 (Asn-Asp). The ADP ribosyltransferase of red cells could help eliminate the NAD+ of serum, but it has been noted that it also takes part in the post-transcriptional modification of other proteins. The RGD motif and DOb take part in cellular adhesion. Oddly the allelic variant DO*B is more common in African and Asian populations and could be an evolutionary advantage against the invasion of *Plasmodium falciparum* which expresses RGD proteins during its infection process.

B.3. Antigens Determined by Expression of Membrane Receptors of Red Cells.

Duffy (FY)

The function of the glycoprotein FY as a cytokine receptor of red cells is to accelerate proinflammatory cytokine signalling. The FY glycoprotein is the erythrocyte receptor for the malarial parasite *Plasmodium vivax* and as a consequence FY negative individuals (FY a-b-) are very common in populations where this parasite is found (Western Africa). Three main alleles of FY exist: FY*A, FY*B and FY*A and B which differ due to an SNP which alters codon 42, while phenotype FY (a⁻b⁻) in Africans is caused by a SNP (C-T) in the FY gene promoter that results in an absence of FY glycoprotein in the erythrocytes.

MNSs (MNS)

The MNS antigens are generated against glycoporin A, while the Ss antigens are against glycoporin B. The genes GYPA and GYPB line up in tandem in the locus 4q28-31 but there is no relationship between glycoporins C and D. Two amino acid changes in the N-terminal region of GPA are responsible for the blood group M-N and a change in amino acid in GPB determines the blood group S-s. A large number of MNS alleles exist due to genetic recombinations, genetic conversions or SNPs.

Human Platelet Antigens

Human platelet antigens (HPA) are human alloantigens expressed only on platelets, specifically on platelet membrane glycoproteins. These antigens can stimulate the production of alloantibodies in recipients of transfused platelets from donors with different HPAs, and can cause neonatal alloimmune thrombocytopenia, post-transfusion purpura and cases of platelet transfusion refractoriness to infusion of donor platelets. There are currently 24 known platelet-specific alloantigens as defined by immune sera, of which 12 are grouped in six biallelic systems (HPA-1, -2, -3, -4, -5, -15). The molecular basis of most of these has been resolved, and most differences between self and non-self is defined by a single amino acid substitution, generally caused by a SNP. Human blood groups have been defined at a genetic level for the majority of antigens with clinical significance. Nevertheless, genotyping of red cells is still only performed rarely, mainly in prenatal determination of blood groups in cases of haemolytic diseases in newborns and fetuses.

The compatibility of blood transfusions between donors and recipients is generally evaluated by serological techniques (antibody-antigen reactions). The use of these techniques can give incorrect results, which could lead to a potential adverse immune reaction in the recipient (patient). No serological tests exist for a high number of the so-called 'weak' genes and on various occasions the antibodies used have not been sufficiently specific. The only process capable of preventing problems of this type is that based on complete molecular genotyping of both the donor and the recipient.

SNP genotyping will allow both these determinations to be carried out on a large scale and also the genotyping of rare alleles in blood groups and platelet antigens that with existing techniques cannot be determined. The appearance of new alleles in certain blood groups (e.g. RH) will continue and will therefore require technology capable of progressing and being constantly monitored. The Human Genome project has identified new SNPs in many proteins in the blood groups concerned, although it still needs to be serologically determined if these SNPs are in antigens related to blood groups.

Molecular analysis has become common in transfusions. For example, detection of viral contamination, such as the hepatitis C virus (HCV), the human immunodeficiency virus (HIV) or the hepatitis B virus (HBV), by PCR methodology from small volumes of plasma has been common practice in the European Union (EU) since 1999. Diagnosis based on PCR has practically taken the place of serology in the determination of HLA (human leukocyte antigen); and is routinely used in transfusion centres involved in bone marrow transplants.

One of the discoveries of the Human Genome project was the high frequency of polymorphisms in a single nucleotide (SNPs) found in human DNA. Approximately one SNP was found for every kilobase. This discovery has pushed forward the technical development of rapid diagnosis of SNP genotyping, for example by using DNA array or particle suspension. This new technology can be applied to developing a rapid method of genotyping of blood groups.

Diverse methods of diagnosis for different blood groups have been described. As an illustrative example, U.S. Pat. No. 5,804,379 relates to a molecular method of diagnosis and a kit to determine the genotypes of the blood group KEL. U.S. Pat. No. 5,723,293 relates to a method and kit to determine the genotypes of the blood group RH. Furthermore a serological diagnostic test to classify blood groups from blood or serum has been described. Likewise new genetic variations of the blood group Duffy have been described as a method of genotyping this blood group.

A DNA array or particle suspension which allows the simultaneous, sensitive, specific and reproducible detection of genetic variations associated with determined erythrocyte antigens could be used clinically for genotyping antigens of blood erythrocytes on a large scale in the population and therefore for determining blood groups in humans.

Some non-limiting examples of genetic variations associated with particular erythrocyte and human platelet antigens which may be assessed by the present methods include those in Table 2 below.

TABLE 2

Genetic variations associated with erythrocyte and human platelet antigens

The polymorphism GG87_88insG (Genotype O4) (BC008) in exon 2 of the gene ABO,
The polymorphism G188A + C189T (Genotype O1v) (BC012) in exon 4 of the gene ABO,
The polymorphisms 261delG (Genotype O1/O1v) (BC001), C322T (Genotype O5) (BC009) in exon 6 of the gene ABO,
The polymorphisms C467T (P156L) (Genotype A2) (BC014), G542A (Genotype O8) (BC013), T646A (Genotype Ax/O1v) (BC015), G703A (Genotype G235S) (B) (BC002), C796A (Genotype L266M) (B) (BC003), G802A (Genotype O2) (BC004), G803C (Genotype G268A) (B, cisAB-1) (BC005), 798-804insG (Genotype O3, Ael) (BC007), C893T (Genotype O6) (BC010), C927A (Genotype O7) (BC011), 1059-1061delC (D FS354 + 21aa) (Genotype A2) (BC006) in exon 7 of the gene ABO,
The polymorphisms C8G (S3C) (Genotype weak D type 3) (BC040), G48A (W16X) (Genotype RHD W16X) (BC046), C121T (Q41X) (Genotype RHD Q41X) (BC047) in exon 1 of the gene RHD,
The polymorphisms A178C, G203A, T307C (exon scanning) (BC016, BC017, BC018), T161C (L54P) (Genotype DMH) (BC033), G270A (W90X) (Genotype RHD W90X) (BC047), T329C (L110P) (Genotype DVII) (BC028) in exon 2 of the gene RHD,
The polymorphisms C340T (Genotype weak D type 17) (BC043), C410T (Genotype DIIIiv) (BC059), C446A (A149D) (Genotype weak D type 5) (BC041), A455C (Genotype DIIIa, DIIIiv, DIVa) (BC060), IVS3 + 1G > A (Genotype negative allele) (BC049) in exon 3 of the gene RHD,
The polymorphisms 488del4 negative genotype allele (BC050), A497C (H166P) (Genotype DFW) (BC030), T509C (M170T) (Genotype DOL) (BC027), A514T (Genotype DFR1) (BC065), T544A, G577A, A594T (Genotype DVI-I weak D type 4) (exon scanning), (BC019, BC020, BC021) in exon 4 of the gene RHD,
The polymorphisms G635T (G212V) (Genotype RHD G212V) (BC051), T667G (Genotype DIIIa, weak D type 4, Dva, DAR, DOL, DCS) (BC061), G676C (Genotype DCS, G686A (Genotype DHR) (BC031), G697C (E233Q), (Genotype G712A (M238V) (DVII, weak D type 4, DV, DCS) (BC022, BC023), A712G (genotype negative allele) (BC023) in exon 5 of the gene RHD,
The polymorphisms T807G (Genotype pseudogene) (BC044), T809G (Genotype weak D type 1) (BC038), G845A (G282D) (Genotype weak D type 15, DIM) (BC037), C848T (T283I) (Genotype DHMI) (BC029), G854A (C285Y) (Genotype DIM) (BC032), G885T (M295I) (Genotype negative allele M295I) (BC053), 906insGGCT (Genotype negative allele) (BC054), G916A, A932G (consensus exon scanning) (BC062, BC063), IVS6 + 1del4 (Genotype allele negative) (BC055) in exon 6 the gene RHD, polymorphisms G941T (G314V) (Genotype negative allele) (BC056), C990G (Y330X) (Genotype negative allele) (BC057), G1016A (G339E) (Genotype weak D type 7) (BC042), T1025C (I342T) (exon scanning) (BC024), G1048C (Genotype DIVa, DIVb) (BC094), G1057A (G353R) (Genotype DNU) (BC034), C1061A (A354N) (Genotype DII) (BC036), G1063A (G355S) (Genotype DNB) (BC026), T1073C (Genotype DWI) (BC035) in exon 7 the gene RHD,
The polymorphism IV8 + 1G > A (Genotype negative allele) (BC058) in exon 8 of the gene RHD,
The polymorphisms G1154C (G385A) (Genotype weak D type 2) (BC039), A1193T (Genotype DIVb) (BC064), G1227A (K409K) (Genotype K409K) (BC045) in exon 9 of the gene RHD,
The polymorphisms G106A (A36T) (Genotype Cx) (BC068), A122G (Q41R) (Genotype Cw) (BC067) in exon 1 of the gene RHCE,
The polymorphism T307C (S103P) (Genotype RHc) (BC066) in exon 2 of the gene RHCE,
The polymorphism C410T (A137V) (BC059) in exon 3 of the gene RHCE,
The polymorphisms C676G (P226A) (Genotype Ee) (BC025, BC069), C733G (L245V) (Genotype VS) (BC070) in exon 5 of the gene RHCE,
The polymorphism G1006T (G336C) (Genotype VS−/VS+) (BC071) in exon 7 of the gene RHCE,
The polymorphisms A697T (Genotype Kk) (BC073), C698T (T193M) (Genotype Kk) (BC072) in exon 6 of the gene KEL,
The polymorphisms T961C (R281W) (Genotype KpaKpb) (BC074), G962A (R281Q) (Genotype KpbKpc) (BC075) in exon 8 of the gene KEL,
The polymorphism G1208A (S363N) (Genotype Kmod-1) (BC077) in exon 10 of the gene KEL,
The polymorphism C1910T (L597P) (Genotype JsaJsb) (BC076) in exon 17 of the gene KEL,
The polymorphism I5AG > AA (Genotype Jknull) (BC079) in exon 6 of the gene SLC14A1 (blood group KIDD),

TABLE 2-continued

Genetic variations associated with erythrocyte and human platelet antigens

The polymorphisms G838A (D280N) (Genotype JkaJkb) (BC078), T871C (S291P) (Genotype Jknull) (BC080) in exon 9 of the gene SLC14A1 (blood group KIDD),
The polymorphisms T-33C (Genotype FYGATA) (BC082), G125A (D42G) (Genotype FYaFYb) (BC081), C265T (R89C) (Genotype FYx) (BC083) in the gene DARC (blood group DUFFY),
The polymorphisms C59T, G71A, T72G (S20L, G42E, G42E) (Genotype MN) (BC084, BC085) in exon 2 of the gene GYPA,
The polymorphism T143C (M48T) (Genotype Ss) (BC086) in exon 4 of the gene GYPB,
The polymorphisms C790A (Genotype GpMUR MiIII) (BC089), C850G (Genotype GpMUR MiIII) (BC090) in exon 3 of the gene GYPE,
The polymorphisms C230T (Genotype U) (BC087), I5 + 5GT (Genotype U) (BC088) in exon 5 of the gene GYPB,
The polymorphism T2561C (P854L) (Genotype DiaDib) (BC091) in exon 19 of the gene SLC4A1 (blood group DIEGO),
The polymorphism A793G (Genotype DoaDob) (BC092) in exon 2 of the gene DOMBROCK,
The polymorphism C134T (A45V) (Genotype CoaCob) (BC093) in exon 1 of the gene COLTON.
The SNP at residue 196 of the gene GPIIIa.
The SNP at residue 2622 of the gene GPIIb.
The SNP at residue 526 of the gene GPIIIa.
The SNP at residue 1600 of the gene GPIa.

Adverse Reactions to Medicine

Any medicine is developed with the intention of curing, relieving, preventing or diagnosing an illness or disease but unfortunately these can also produce adverse effects with a risk, which, depending on the specific case, could range from minimal to severe. Although difficult to calculate, the risk of the treatment should not be ignored and the order of magnitude should be known by the doctor and also the patient and accepted, with the understanding that the potential benefit of the medicine compensates any of these risks.

An adverse reaction is any harmful or unwanted effect that happens after the administration of the dose usually prescribed to a human being for the prophylaxis, diagnosis or treatment of a disease. Present consensus allows this definition, which was created by the World Health Association in 1972, to be understood in the following manner: "It is any unwanted effect that appears on administering a medicine of adequate dose, for the prophylaxis, diagnosis or treatment of a disease or for the modification of a physiological function."

Developed countries count on systems of drug vigilance to centralize the supervision of security and efficiency of drugs used, which are responsible for collecting and analyzing details of adverse reactions suspected of being produced by the drug used on the market.

In Spain the first steps in creating a system of pharmacovigilance were started in the 70s and in 1983, Spain incorporated the International Programme of Pharmacovigilance of Health. In 1992 a computerized database called FEDRA (Spanish Pharmacovigilance of Data of Adverse Reactions) was created. The pharmaceutical industry actively collaborates with this system, and moreover as established by The 1986 General Health Act, and also The 1990 Medicine Act, all public health personnel, including doctors, pharmacists, vets and nurses, are obliged to notify health authorities of any suspicion of adverse reactions to drugs known to them and to collaborate with the Spanish system of pharmacovigilance. Spain also collaborates with the European Medical Evaluation Agency which came into operation in 1995. From the information collected by FEDRA it appears that Spain is within the group of countries with the highest rate of notification, with an average similar to Germany and France although lower than countries such as the USA, Ireland, Norway, New Zealand, The UK or Sweden.

Nowadays, in countries like Spain, where the older population is growing and more medicine is being administered, particularly to this age group and also with increasing self-medication, it is only to be expected that the problem of adverse reactions may be important. The Centre for Drug Evaluation and Research of the FDA (U.S. Food and Drug Administration), confirms that more than two million adverse reactions occur annually in the USA, which cause about 100,000 deaths a year, being the fourth cause of death ahead of lung disease, diabetes, AIDS, pneumonia and traffic accidents. The number of patients that die in England and Wales due to errors in prescription of medicines or adverse reactions is growing and the difficulty is that the extent of the problem is not known. In Spain, five out of every hundred casualty cases in public hospitals are due to adverse reactions to drugs and between 10-20% of those hospitalized suffered this medical mishap on receiving medication. Of those affected, 1% die as a consequence.

Until May 2000 about 80,000 notifications of adverse reactions to registered drugs had been recorded in the database at the Centre for Pharmaceutical Vigilance in Catalunya. Of these, two thirds were spontaneous and came from primary care. Of those reactions notified most were minor or moderate, whilst 12% were serious and 1% fatal. 50% of reactions were skin, digestive or neurological. The majority of decisions to withdraw drugs are related to hepatic/liver and haematological reactions. What causes concern is that these types of reactions, which represent a small percentage of the total, are those where the majority of drugs are withdrawn. Antibiotics are the main cause of adverse effects, followed by anti-rheumatic drugs and painkillers and drugs to prevent cardiovascular disease. The detection of adverse effects can provoke not only the withdrawal but also the decision to change the use of the drug, or the reformulation or introduction of new directions for specific patients.

A DNA array or particle suspension, which allows the simultaneous, sensitive, specific and reproducible detection of genetic variations associated with adverse reactions to medicine, could be clinically useful to prevent or reduce the aforementioned reactions in patients receiving medical treatment.

Some non-limiting examples of genetic variations associated with adverse reactions to pharmaceuticals which may be assessed by the present methods include those in Table 3 below.

TABLE 3

Genetic variations associated with adverse reactions to pharmaceuticals

The polymorphism Arg389Gly in the adrenergic beta 1 receptor (ADRB1)
The polymorphisms Arg16Gly and Gln27Glu in the adrenergic beta 2 receptor (ADRB2),
The polymorphism Ser9Gly of the dopamine receptor D3 (DRD3),
The polymorphisms His452Tyr and T102C of the serotonin receptor 2A (HTR2A),
The polymorphism Val108Met of Catechol-O-methyltransferase (COMT),
The polymorphism Ile105Val of Glutathione S transferase class 1 (GSTP1),
The polymorphism Gly460Trp of Adducin 1 (ADD1),
The polymorphism Arg399Gln of the DNA repair protein XRCC1,
The polymorphism Ile462Val of the cytochrome P450 1A1 (CYP1A1),
The polymorphism A1166C of the angiotensin II, type 1 receptor (AGTR1),
The polymorphism C-58T of the receptor B2 of bradykinin (BDKRB2),
The polymorphism Met235Thr of angiotensinogen (AGT),
The polymorphisms C430T, A1075C, 818delA, T1076C and C1080G of the cytochrome P450 2C9 (CYP2C9),
The polymorphisms H324P, V136V, V11M, C882G, C1038T, G4180C, A1847G, C-1584G, C100T, 138insT, C1023T, G1659A, 1707T/del, G1758A/T, 1863ins9bp, 1973insG, 2539delAACT, 2549A/del, 2613delAGA, C2850T, G3183A, C3198G, T3277C, G4042A and 4125insGTGCCCACT of the cytochrome P450 2D6 (CYP2D6),
The polymorphisms A805T, G416A, A1196G and C792G of the cytochrome P450 2C8 (CYP2C8),
The polymorphisms T341C, C481T, A803G, C282T, G590A, G857A and G191A of N-acetyltransferase 2 (NAT2),
The polymorphisms G636A, G681A, C680T, A1G, IVS5 + 2T > A, T358C, G431A and C1297T of the cytochrome P450 2C19 (CYP2C19),
The polymorphism C2664T of the glutamate receptor ionotropic, N-methyl D-asparate (NMDA) 2B (GRIN2B),
The polymorphism C3435T of glycoprotein P (ABCB1),
The polymorphisms A719G and G238C of thiopurine S-methyltransferase (TPMT),
The polymorphism C677T of 5,10-methylenetetrahydrofolatereductase (MTHFR)
The polymorphisms Asp70Gly and Ala539Thr of butyrylcholinesterase (BCHE),
The polymorphism A-392G of the cytochrome P450 3A4 (CYP3A4),
The polymorphisms A-163C, A-3860G, G3534A and C558A of the cytochrome P450 1A2 (CYP1A2),
The polymorphisms G14690A, C3699T, G19386A, T29753C and G6986A of the cytochrome P450 3A5 (CYP3A5),
The polymorphism 44bp deletion of the promotor of the serotonin transporter (SLC6A4),
The polymorphism delAGA (allele*B) of Glutathione S-transferase M3 (GSTM3),
The polymorphism null allele of Glutathione S-transferase M1 (GSTM1),
The polymorphism null allele of Glutathione S-transferase n1 (GSTT1),
The polymorphisms Cys112Arg and Arg158Cys of apolipoprotein E (APOE),
The polymorphism G-308A of Tumor necrosis factor (TNF), and
The polymorphism G-1082A of Interleukin 10 (IL10)

The sequences of all the genes mentioned in Tables 1-3 are known and recognized on the following websites: GeneBank (NCBI), GeneCard (Weizmann Institute of Sciences) and Snpper.chip.org (Innate Immunity PGA).

By permitting clinical genotyping of one or more of the above genetic variations, the present method has use in for example, diagnosing susceptibility to or the presence of IBD or adverse reactions to pharmaceuticals. The methods also allow reliable determination of erythrocyte antigens and are useful in blood grouping or typing.

At least one genetic variation is analysed in the present methods. The present methods allow simultaneous genotyping of multiple variations in an individual and typically multiple variations are analysed, in general, at least 10, 12, 14, 16, 18 or 20 genetic variations. For example, 30, 40, 50, 60, 70, 80 or 100 variations or up to 200, 300, 400, 500, or 600 variations may be tested, such as 250, 350 or 450 variations.

Thus the present methods may be used for genotyping an individual with respect to all of the variations in any one of Tables 1 to 3, or a selection of the variations in any one of the Tables, as described herein. Thus the variations to be detected may comprise or be selected from any one of Tables 1 to 3.

According to the present methods, a sample is provided, containing nucleic acid which comprises at least one of the genetic variations to be tested (the target DNA). The nucleic acid comprises one or more target regions comprising the genetic variation(s) which are to be characterised.

The nucleic acid may be obtained from any appropriate biological sample which contains nucleic acid. The sample may be taken from a fluid or tissue, secretion, cell or cell line derived from the human body.

For example, samples may be taken from blood, including serum, lymphocytes, lymphoblastoid cells, fibroblasts, platelets, mononuclear cells or other blood cells, from saliva, liver, kidney, pancreas or heart, urine or from any other tissue, fluid, cell or cell line derived from the human body. For example, a suitable sample may be a sample of cells from the buccal cavity.

Preferably nucleic acid is obtained from a blood sample.

In general, nucleic acid is extracted from the biological sample using conventional techniques. The nucleic acid to be extracted from the biological sample may be DNA, or RNA, typically total RNA. Typically RNA is extracted if the genetic variation to be studied is situated in the coding sequence of a gene. Where RNA is extracted from the biological sample, the methods further comprise a step of obtaining cDNA from the RNA. This may be carried out using conventional methods, such as reverse transcription using suitable primers. Subsequent procedures are then carried out on the extracted DNA or the cDNA obtained from extracted RNA. The term DNA, as used herein, may include both DNA and cDNA.

In general the genetic variations to be tested are known and characterised, e.g. in terms of sequence. Therefore nucleic acid regions comprising the genetic variations may be obtained using methods known in the art.

In one aspect, DNA regions which contain the genetic variations to be identified (target DNA regions) are subjected to an amplification reaction in order to obtain amplification products which contain the genetic variations to be identified. Any suitable technique or method may be used for amplification. In general, the technique allows the (simultaneous) amplification of all the DNA sequences containing the genetic variations to be identified. In other words, where multiple genetic variations are to be analysed, it is preferable to simultaneously amplify all of the corresponding target DNA regions (comprising the variations). Carrying out the amplification in a single step (or as few steps as possible) simplifies the method.

For example, multiplex PCR may be carried out, using appropriate pairs of oligonucleotide PCR primers which are capable of amplifying the target regions containing the genetic variations to be identified. Any suitable pair of primers which allow specific amplification of a target DNA region may be used. In one aspect, the primers allow amplification in the least possible number of PCR reactions. Thus, by using appropriate pairs of oligonucleotide primers and appropriate conditions, all of the target DNA regions necessary for genotyping the genetic variations can be amplified for genotyping (e.g. DNA-array or particle suspension) analysis with the minimum number of reactions. Suitable PCR primers for amplification of target DNA regions comprising genetic variations associated with erythrocyte antigens, IBD, adverse reaction to pharmaceuticals, are described in copending U.S. application Ser. No. 11/813,646. In particular, PCR primers for amplification of target DNA regions comprising the genetic variations associated with IBD, erythrocyte antigens, and adverse reaction to drugs are listed in copending U.S. application Ser. No. 11/813,646. Other examples may be found in copending U.S. Patent Application Ser. Nos. 61/210, 124 (Multiple sclerosis), 61/185,187 (Hypercholesterolemia); 12/309,206 (Rheumatoid Arthritis); 12/309,162 (Osteoporosis); 12/309,208 (Prostate cancer); and International Patent Application number PCT/ES2004/070001 (Familial Hypercholesterolemia). The present method may comprise the use of one or more of these primers or one or more of the listed primer pairs.

In one instance, the amplification products can be labelled during the amplification reaction with a detectable label. The aim is to be able to later detect hybridisation between the fragments of target DNA containing the genetic variations being analysed and probes fixed on a solid support. The greater the extent of hybridisation of labelled target DNA to a probe, the greater the intensity of detectable label at that probe position.

The amplification products may be labelled by conventional methods. For example, a labelled nucleotide may be incorporated during the amplification reaction or labelled primers may be used for amplification. In some embodiments, the labelled nucleotide is a biotinylated nucleotide. In other embodiments, the labelled primer is a biotinylated primer.

Labelling may be direct using for example, fluorescent or radioactive markers or any other marker known by persons skilled in the art. Examples of fluorophores which can be used, include for example, Cy3 or Cy5. Alternatively enzymes may be used for sample labelling, for example alkaline phosphatase or peroxidase. Examples of radioactive isotopes which can be used include for example $^{33}$P, $^{125}$I, or any other marker known by persons skilled in the art. In one instance, labelling of amplification products is carried out using a nucleotide which has been labelled directly or indirectly with one or more fluorophores. In another example, labelling of amplification products is carried out using primers labelled directly or indirectly with one or more fluorophores.

Labelling may also be indirect, using, for example, chemical or enzymatic methods. For example, an amplification product may incorporate one member of a specific binding pair, for example avidin or streptavidin, conjugated with a fluorescent marker and the probe to which it will hybridise may be joined to the other member of the specific binding pair, for example biotin (indicator), allowing the probe/target binding signal to be measured by fluorimetry. In another example, an amplification product may incorporate one member of a specific binding pair, for example, an anti-dioxigenin antibody combined with an enzyme (marker) and the probe to which it will hybridise may be joined to the other member of the specific binding pair, for example dioxigenin (indicator). On hybridization of amplification product to probe the enzyme substrate is converted into a luminous or fluorescent product and the signal can be read by, for example, chemiluminescence or fluorometry.

The nucleic acid comprising the genetic variation(s) to be tested, e.g. the (optionally labelled) amplification products, may further undergo a fragmentation reaction, thereby obtaining some fragmentation products which comprise or contain the genetic variations to be identified or analysed. Typically fragmentation increases the efficiency of the hybridisation reaction. Fragmentation may be carried out by any suitable method known in the art, for example, by contacting the nucleic acid, e.g. the amplification products with a suitable enzyme such as a DNase.

If the nucleic acid has not been previously labelled, e.g. during the amplification reaction, (and, typically, where no posthybridisation amplification or ligation is carried out on the solid support) then labelling with a detectable label may be carried out prehybridisation by labelling the fragmentation products. Suitable labelling techniques are known in the art and may be direct or indirect as described herein. Direct labelling may comprise the use of, for example, fluorophores, enzymes or radioactive isotopes. In one embodiment, the direct labelling comprises the use of biotin. Indirect labelling may comprise the use of, for example, specific binding pairs that incorporate e.g. fluorophores, enzymes, etc. For example, if amplification products have not been labelled during the amplification reaction the fragmentation products may undergo a direct or indirect labelling with one or various markers, for example biotin or one or various fluorophores, although other known markers can be used by those skilled in the art.

According to the present methods the nucleic acid, e.g. the amplification or fragmentation products, comprising the genetic variation(s) to be detected (target DNA), is contacted with oligonucleotide probes which are capable of detecting the corresponding genetic variations by hybridisation under suitable conditions.

Typically the hybridisation conditions allow specific hybridisation between probes and corresponding target nucleic acids to form specific probe/target hybridisation complexes while minimising hybridisation between probes carrying one or more mismatches to the DNA. Such conditions may be determined empirically, for example by varying the time and/or temperature of hybridisation and/or the number and stringency of the array or suspension washing steps that are performed following hybridisation and are designed to eliminate all probe-DNA interactions that are in specific.

In the method, the probes are provided deposited on a solid support or surface. In the case of a DNA-chip, the probes are deposited at positions on the solid support according to a predetermined pattern. In the case of a DNA particle suspension, each species of probe is attached to a uniquely identifiable particle. It has been found that the particle suspensions should comply with a number of requirements in order to be used in the present methods, for example in terms of the design of the probes, the number of probes provided for each genetic variation to be detected and the distribution of probes on the support. These are described in detail herein. The inventors have developed suitable genotyping arrays and suspensions for use in the present methods and accordingly in one aspect the invention provides a DNA-array comprising a plurality of probes deposited or immobilised on a solid support as described herein. In general the solid support or phase comprises oligonucleotide probes suitable for detection of each genetic variation to be tested. The number and type of genetic variations to be tested using an array or particle suspension may be selected as described herein.

Typically there will be at least one probe which is capable of hybridising specifically to genetic variation A (e.g. a wild-type or normal allele) (probe 1) and one probe which is capable of hybridising specifically to genetic variation B (e.g. a mutant allele) (probe 2) under the selected hybridisation conditions. These probes form a probe pair. Probe 1 is for detection of genetic variation A and probe 2 for detection of genetic variation B. Typically the probes can be used to discriminate between A and B (e.g. the wildtype and mutant alleles).

The probes may examine either the sense or the antisense strand. Typically, probes 1 and 2 examine the same nucleic acid strand (e.g. the sense strand or antisense strand) although in some cases the probes may examine different strands. In one aspect probes 1 and 2 have the same sequence except for the site of the genetic variation.

In one instance, the probes in a probe pair have the same length. In some aspects, where two or more pairs of probes are provided for analysis of a genetic variation, the probes may all have the same length.

In some aspects of the invention one pair of probes is provided for each genetic variation to be tested. In other aspects of the invention more than one probe pair is provided for detection of each genetic variation. Thus, at least 1, 2, 3, 4, 5, 6, 7, 8, 9, 10 or more probe pairs may be provided per genetic variation. In one aspect, (at least) 2 probe pairs are provided. The aim is to reduce the rate of false positives and negatives in the present methods.

For example, for a given genetic variation there may be:
Probe 1 which is capable of hybridising to genetic variation A (e.g. a normal allele)
Probe 2 which is capable of hybridising to genetic variation B (e.g. a mutant allele)
Probe 3 which is capable of hybridising to genetic variation A (e.g. a normal allele)
Probe 4 which is capable of hybridising to genetic variation B (e.g. a mutant allele).

The probes may examine the same or different strands. Thus in one embodiment, probes 3 and 4 are the complementary probes of probes 1 and 2 respectively and are designed to examine the complementary strand. In one aspect it is preferred that the probes provided for detection of each genetic variation examine both strands.

In some aspects of the invention more than 2 pairs of probes may be provided for analysis of a genetic variation as above. For example, where a genetic variation exists as any one of 4 bases in the same strand (e.g. there are three mutant possibilities), at least one pair of probes may be provided to detect each possibility.

Thus, for example, for the SNP G2677T/A/C, at least one pair of probes may be provided for detection of G2677T, one pair for detection of G2677/A, and one pair for detection of G2677C. In one embodiment, at least two pairs of probes are provided for each of these substitutions. In another embodiment the method comprises use of one pair of probes.

A number of methods are known in the art for designing oligonucleotide probes suitable for use in DNA-arrays. A "standard tiling" method may be used. In this method, 4 oligonucleotides are designed that are totally complementary to the reference sequence except in the central position where, typically the 4 possible nucleotides A, C, G and T are examined. An illustrative example of this strategy is the DNA-chip for genotyping of HIV-1 (Affymetrix).

In "alternative tiling" 5 oligonucleotides are designed, so that the fifth examines a possible deletion in the sequence. An example of this strategy is the DNA-chip to detect mutations in p53 (Affymetrix).

In "block tiling" 4 oligonucleotides are designed that are totally complementary to the normal sequence and another 4 totally complementary to the mutant sequence. The nucleotide which changes is placed in the central position, but a mismatch of one of the 4 bases (A, C, T or G) is placed 2 nucleotides before or after the nucleotide position that it is wished to interrogate. An example of this strategy is the DNA-chip for the detection of mutations in cytochrome p450 (Roche and Affymetrix).

A further example is "alternative block tiling" where the "mismatch" is used to increase the specificity of the hybrid not only in one position but also in the positions −4, −1, 0, +1 and +4 to identify the change produced in the central position or 0. An example is the DNA-chip to detect 1,500 SNPs (Affymetrix).

Any one or more of these strategies may be used to design probes for the present invention. Preferably standard tiling is used, in particular with 2 pairs of probes e.g. 2 pairs of complementary probes as above. Thus it is preferable that the oligonucleotide sequence is complementary to the target DNA or sequence in the regions flanking the variable nucleotide(s). However, in some cases, one or more mismatches may be introduced, as described above.

The oligonucleotide probes for use in the present invention typically present the base to be examined (the site of the genetic variation) at the center of the oligonucleotide. This is particularly the case where differential hybridisation methods are used, as in general this allows the best discrimination between matched and mismatched probes. In these methods, typically there is formation of specific detectable hybridisation complexes without post-hybridisation on-chip amplification. For example, for precise (single base) mutations, the base which differs between the normal and the mutant allele is typically placed in the central position of the probe. In the case of insertions, deletions and duplications, the first nucleotide which differs between the normal and the mutant sequence is placed in the central position. It is believed that placing the mutation at the centre of the probe maximises specificity.

Where post-hybridisation amplification on the solid support (e.g. ligation or primer extension methods) is employed, oligonucleotide probes typically present the variable base(s) at the 3' end of the probe. Where OLA methodology is used, oligonucleotides (labelled directly or indirectly) are also designed which hybridise to probe-target complexes to allow ligation.

In general the probes for use in the present invention comprise or in some embodiments consist (essentially) of 17 to 27 nucleotides, for example, 19, 21, 23, or 25 nucleotides or 18, 20, 22, 24 or 26 nucleotides.

Preferably the individual probes provided for detection of a genetic variation are capable of hybridising specifically to the normal and mutant alleles respectively under the selected hybridisation conditions. For example, the melting temperature of the probe/target complexes may occur at 75-85 degrees C. and hybridisation may be for one hour, although higher and lower temperatures and longer or shorter hybridisations may also suffice. The probes provided for detection of each genetic variation (as described above) are typically capable of discriminating between genetic variation A and B (e.g. the normal and mutant alleles) under the given hybridisation conditions as above. Preferably the discrimination capacity of the probes is substantially 100%. If the discrimination capacity is not 100%, the probes are preferably redesigned. Preferably the melting temperature of the probe/target complexes occurs at 75-85 degrees C. Methods for testing discrimination capacity are described herein.

In one example, the probes provided for detection of a genetic variation examine both strands and have lengths ranging from 19-27 nucleotides. Preferably the probes have 100% discrimination capacity and the melting temperature of probe/target complexes is 75-85 degrees C.

Typically in order to obtain probes for use in the present methods, a number of probes are designed and tested experimentally for, e.g. hybridisation specificity and ability to discriminate between genetic variants (e.g. a normal and a mutant allele). Candidate oligonucleotide probe sequences may be designed as described above. These may vary for example in length, strand specificity, position of the genetic variation and degree of complementarity to the sequence flanking the genetic variation in the target DNA. Once probe pairs have been designed, these can be tested for hybridisation specificity and discrimination capacity. The capacity of specific probes to discriminate between the genetic variations A and B (e.g. normal and mutant alleles) depends on hybridisation conditions, the sequence flanking the mutation and the secondary structure of the sequence in the region of the mutation. By using stable hybridisation conditions, appropriate parameters such as strand specificities and lengths can be established in order to maximise discrimination. Preferably, the genetic variation is maintained at the central position in the tested probes.

Methods for testing discrimination capacity of probes are described herein. Typically a number of candidate probe pairs are provided and used in a training method as described below. In general two pairs of probes (probes 1 and 2, and probes 3 and 4) are tested in the method. For example, two pairs of probes examining both strands (complementary to each other) may be tested. If it is not possible to obtain 100% discrimination between the three genotyping groups using the probes, the probes are typically redesigned. Hybridisation conditions in the training method are generally maintained stably. Typically the melting temperature of probe/target complexes is 75-85 degrees C.

For example, starting from probes of 25 nucleotides which detect a genetic variation (e.g. the normal allele) and another genetic variation (e.g. a mutant allele) in both strands (sense and antisense), in general an average of 8 probes may be experimentally tested to identify two definite pairs.

Probes are chosen to have maximum hybridisation specificity and discrimination capacity between genetic variants (e.g. a normal and a mutant allele) under suitable hybridisation conditions. For example, the probes for detection of a given genetic variation, e.g. two probe pairs, typically have substantially 100% discrimination capacity. Typically the melting temperature of probe/target complexes is at 75-85° C.

Using the methods herein the inventors have developed oligonucleotide probes suitable for detection of the IBD-associated genetic variations in Table 1. These probes are presented as SEQ ID NOS 631-960 and 1429-1652 in copending U.S. application Ser. No. 11/813,646. The probes are listed in probe sets (133 sets in total), each set being for detection of a given genetic variation. At least two pairs of probes are listed in each set.

The inventors have also developed oligonucleotide probes suitable for detection of the erythrocyte antigen-associated genetic variations in Table 2. These probes are presented as SEQ ID NOS 255-630 in copending U.S. application Ser. No. 11/813,646. The probes are listed in probe sets (94 sets in total), each set being for detection of a given genetic variation. At least two pairs of probes are listed in each set.

The inventors have also developed oligonucleotide probes suitable for detection of the genetic variations associated with adverse reactions to drugs in Table 3. These probes are presented as SEQ ID NOS 961-1316 in copending U.S. application Ser. No. 11/813,646. The probes are listed in probe sets (89 sets in total), each set being for detection of a given genetic variation. At least two pairs of probes are listed in each set.

In one aspect the invention relates to the use of any one or more of the oligonucleotide probes, pairs of probes or sets of probes set out as SEQ ID NOS 255-630, 631-960, 961-1316 or 1429-1652 in copending U.S. application Ser. No. 11/813, 646. In some embodiments the invention relates to their use in the genotyping, diagnostic or therapeutic methods of the invention. In another embodiment, the invention relates to their use in medicine, for example in a diagnostic or therapeutic method described herein. A chip or particle suspension of the invention may comprise one or more of the listed probe pairs or sets.

In general probes are provided on the support in replicate. Typically, at least 2, 4, 6, 8, 10, 12, 14, 16, 18 or 20 replicates are provided of each probe, in particular, 6, 8 or 10 replicates. Thus for example, the solid support may comprise or include 10 replicates for each of (at least) 4 probes used to detect each genetic variation (i.e. 40 probes). Alternatively the solid support may comprise or include 8 replicates for each of (at least) 4 probes used to detect each genetic variation (i.e. 32 probes). Still further the solid support may comprise or include 6 replicates for each of (at least) 4 probes used to detect each genetic variation (i.e. 24 probes). Using probe replicates helps to minimise distortions in data interpretation from the chip and improves reliability of the methods.

In general the support also comprises one or more control oligonucleotide probes. These are also provided in replicate as above. Thus the solid support may additionally comprise one or more oligonucleotides deposited on the support which are useful as positive and/or negative controls of the hybridisation reactions. If post-hybridisation amplification or ligation reactions are carried out on the solid support, there may also be one or more positive or negative controls of these reactions.

Typically the chip or suspension will include positive control probes, e.g., probes known to be complementary and hybridisable to sequences in the target polynucleotide molecules, probes known to hybridise to an external control DNA, and negative control probes, e.g., probes known to not be complementary and hybridizable to sequences in the target polynucleotide molecules. The chip or suspension may have one or more controls specific for each target, for example, 2, 3, or more controls. There may also be at least one control.

On a planar array, positive controls may for example be synthesized along the perimeter of the array or in diagonal stripes across the array. The reverse complement for each probe may be synthesized next to the position of the probe to serve as a negative control. In yet another example, sequences from other species of organism may be used as negative controls in order to help determine background (non-specific) hybridisation.

As above, the support may include some (one or more) oligonucleotides deposited on the support which are useful as positive and negative controls of the hybridization reactions. In one embodiment, the support is a chip. In another embodiment, the support is a suspension of particles such as microparticles or nanoparticles. In one embodiment, the microparticles are beads. In some embodiments the particles may be immobilized on a planar surface to comprise a planar array. In another embodiment, the particles are in a suspension buffer. For example, in a DNA-chip, each one of the sub-arrays, for example 16, which typically constitute a DNA-chip, is flanked by some external hybridization controls, which serve as reference points allowing allow the points within the grid to be located more easily. In one instance, the nucleotide sequence of an external control DNA is the following (5'->3'):

```
CEH:
                                 SEQ ID NO: 1653
GTCGTCAAGATGCTACCGTTCAGGAGTCGTCAAGATGCTACCGTTCAGGA
``` and the sequences of the oligonucleotides for its detection are the following:

```
ON1:    CTTGACGACTCCTGAACGG    SEQ ID NO: 1654

ON2:    CTTGACGACACCTGAACGG    SEQ ID NO: 1655
```

Positive control probes are generally designed to hybridise equally to all target DNA samples and provide a reference signal intensity against which hybridisation of the target DNA (sample) to the test probes can be compared. Negative controls comprise either "blanks" where only solvent (DMSO) has been applied to the support or control oligonucleotides that have been selected to show no, or only minimal, hybridisation to the target, e.g. human, DNA (the test DNA). The intensity of any signal detected at either blank or negative control oligonucleotide features is an indication of non-specific interactions between the sample DNA and the array or suspension and is thus a measure of the background signal against which the signal from real probe-sample interactions must be discriminated.

Desirably, the number of sequences in the array or suspension will be such that where the number of nucleic acids suitable for detection of genetic variations is n, the number of positive and negative control nucleic acids is n', where n' is typically from 0.01 to 0.4n.

In general, the support is suitable for genotyping, in particular, genotyping according to the present methods. The support typically comprises probes suitable for detection of at least one but preferably multiple, genetic variation(s), typically at least 10, 12, 14, 16, 18 or 20 genetic variations. For example, 30, 40, 50, 60, 70, 80 or 100 variations or up to 200, 300, 400, 500, or 600 variations may be tested, such as 250, 350 or 450 variations.

The genetic variations may be but are not limited to those in any one of Tables 1 to 3. Thus an array or suspension may comprise probes suitable for genotyping an individual with respect to all of the variations in any one of Tables 1 to 3, or a selection of the variations in any one of the Tables, as described above. Other genetic variations such as those related to multiple sclerosis, rheumatoid arthritis, familial hypercholesterolemia, prostate or other cancers, or other diseases or conditions with which genetic variations are associated may be used in the methods of the invention.

The present DNA arrays and particle suspensions can be used, in combination with the present methods, to detect practically any human genetic variation of interest, for example, human genetic variations associated with diseases or antigens of interest. Suitable probes will be used for those genetic variations to be detected. As genetic variations associated with the diseases or antigens of interest are identified, suitable probes for their detection can be incorporated in the chips. Probes and DNA arrays or particle suspensions for this purpose can be designed in accordance with the teaching of the present invention.

The inventors have designed, produced and validated the clinical use of the invention in detection of genetic variations associated with IBD, with known human erythrocyte antigens and with adverse reactions to medicine by developing (designing and producing) corresponding DNA arrays and particle suspensions. The methods may also be used for detection of genetic variations associated with other diseases and conditions, including but not limited to Multiple Sclerosis (MS), familial hypercholesterolemia (FH); Rheumatoid Arthritis (RA), Osteoporosis (Ost), or prostate cancer (Pro). See copending U.S. Patent Application Ser. Nos. 61/210,124 (MS), 61/185,187 (FH); 12/309,206 (RA); 12/309,162 (Ost); 12/309,208 (Pro); and International Patent Application number PCT/ES2004/070001 (FH). Therefore, in one particular embodiment, the invention relates to a chip for genotyping of genetic variations associated with IBD. Typically the DNA array or particle suspension allows simultaneous, sensitive, specific and reproducible detection of genetic variations associated with IBD. Non-limiting examples of such variations are given in Table 1. Nevertheless, the number of genetic variations contained in the Table can be increased as other genetic variations are subsequently identified and are associated with IBD. Thus the genetic variations detectable by the arrays or suspensions may comprise, or consist (essentially) of those listed in Table 1 or a selection of these. The arrays or suspensions will comprise probes suitable for detection of these genetic variations as described herein. In one aspect the chip or suspension comprises probes selected from those in SEQ ID NOS 631-960 and 1429-1652 in copending U.S. application Ser. No. 11/813,646. The probes are listed in probe sets (133 sets in total), each set being for detection of a given genetic variation. At least two pairs of probes are provided in each set. A chip may comprise at least one probe pair or at least one probe set, or a selection of the probe sets, for example, at least 5, 10, 20, 30, 40, 50, 60, 70, 80, 90, 100, 110, 120, 130 or all 133 sets, according to the genetic variations being tested. A chip or suspension may comprise other probes for detection of variations in Table 1 or other variations associated with IBD instead of or in addition to those specifically listed.

In another embodiment the array is for genotyping of genetic variations associated with erythrocyte antigens. Typically the DNA array or suspension allows the simultaneous, sensitive, specific and reproducible detection of genetic variations associated with determined erythrocyte antigens. Non-limiting examples of such variations are given in Table 2. Nonetheless the number of genetic variations contained in the table can be increased as other genetic variations are subsequently identified and are associated with erythrocyte antigens. Thus the genetic variations detectable by the chip may comprise, or consist (essentially) of those listed in Table 2 or a selection of these. The array or particle suspension will comprise probes suitable for detection of these genetic variations as described herein. In one aspect the array or particle suspension comprises probes selected from those in SEQ ID NOS 255-630 in copending U.S. application Ser. No. 11/813, 646. The probes are listed in probe sets (94 sets in total), each set being for detection of a given genetic variation. At least two pairs of probes are provided in each set. An array or particle suspension may comprise at least one probe pair or at least one probe set, or a selection of the probe sets, for example, at least 5, 10, 20, 30, 40, 50, 60, 70, 80, 90, or all 94 sets, according to the genetic variations being tested. A chip or particle suspension may comprise other probes for detection of variations in Table 2 or other variations associated with erythrocyte antigens instead of or in addition to those specifically listed.

In another embodiment the array or particle suspension is for genotyping of genetic variations associated with adverse reactions to pharmaceuticals. Typically the array or particle suspension allows the simultaneous, sensitive, specific and reproducible detection of genetic variations associated with adverse reactions to medicine. Non-limiting examples are given in Table 3. Nevertheless, the number of genetic variations contained in the table can be increased as other genetic variations are subsequently identified and are associated with these adverse reactions. Thus the genetic variations detectable by the chip or suspension may comprise, or consist (essentially) of those listed in Table 3 or a selection of these. The chip or suspension will comprise probes suitable for detection of these genetic variations as described herein. In one aspect the array or particle suspension comprises probes selected from those in SEQ ID NOS 961-1316 in copending U.S. application Ser. No. 11/813,646. The probes are listed in probe sets (89 sets in total), each set being for detection of a given genetic variation. At least two pairs of probes are provided in each set. An array or particle suspension may comprise at least one probe pair or at least one probe set, or a selection of the probe sets, for example, at least 5, 10, 20, 30, 40, 50, 60, 70, 80, or all 89 sets, according to the genetic variations being tested. A chip or particle suspension may comprise other probes for detection of variations in Table 3 or other variations associated with adverse reactions to drugs instead of or in addition to those specifically listed.

In addition to DNA-arrays in the form of DNA-chips to detect genetic polymorphisms, the present inventions also contemplates the use of DNA particle suspensions, especially in cases where only a few genes or signatures are needed for genotyping or diagnosis of a condition. In some embodiments, the solid support to which the probes are attached is a particle, typically glass, each particle being coded with an identifier such as a bar code or fluorescent dye. Other examples are listed below. In some embodiments according to the methods of the invention the particle is a nanoparticle, typically having a diameter of between 1 and 100 nanometers. In other embodiments, the particle is a microparticle, typically between 0.1 and 100 micrometers in size. In some embodiments the particles are spherical, such as microspheres or nanospheres. In other embodiments the size limitations may be restricted to two dimensions, resulting for example in a cylindrical particle.

Platforms such as the XMAP™ technology from Luminex is one example, wherein the particles are microspheres encoded with fluorescent dyes. The particles are read by a flow cytometer. Another example is the genotyping assays from Illumina, Inc. in which the particles are cylindrical beads encoded with a barcode, which are then read by a barcode scanner.

An array or particle suspension according to the instant invention may additionally comprise oligonucleotide probes for detection of genetic variations associated with more than one indication. For example, the arrays or particle suspensions may comprise probes for detection of genetic variations such as SNPs associated with another (related) condition or other (related) antigen(s). Typically, in an array or particle suspension, the number of nucleic acids suitable for detection of genetic variations associated with any one of the contemplated indications represent at least 50%, 60%, 70%, 75%, 80%, 85%, 90%, 95%, 97%, 98%, 99% or more of the nucleic acids in the array or particle suspension.

As used herein, the term "solid support", on which the plurality of probes is deposited, can be any solid support to which oligonucleotides can be attached. Practically any support, to which an oligonucleotide can be joined or immobilized, and which may be used in the production of DNA probe arrays and particle suspensions, can be used in the invention. For example, the said support can be of a non-porous material, for example, glass, silicone, plastic, or a porous material such as a membrane or filter (for example, nylon, nitrocellulose) or a gel. In one embodiment, the said support is a glass support, such as a glass slide. In another embodiment, the support is a particle in suspension, as described above, such as a microparticle. Microparticles useful for the methods of the invention are commercially available for example from Luminex Inc., Invitrogen (Carlsbad, Calif.), and Polysciences Inc. (Warrington, Pa.).

In general a chip DNA array has from 300 to 40000 nucleic acids (probes), for example, from 400 to 30000 or 400 to 20000. The chip may have from 1000 to 20000 probes, such as 1000 to 15000 or 1000 to 10000, or 1000 to 5000. A suitable chip may have from 2000 to 20000, 2000 to 10000 or 2000 to 5000 probes. For example, a chip may have 1000, 2000, 3000, 4000, 5000, 6000, 7000, 8000, 9000, 10000, 12000, 14000, 16000, 18000 or 20000 probes. Smaller chips 400 to 1000 probes, such as 400, 500, 600, 700, 800, 900 or 950 probes are also envisaged. The number of probes in a particle suspension will vary depending on the number of individually identifiable particles.

In general the chip DNA array of the invention comprises a support or surface with an ordered array of binding (e.g. hybridisation) sites or probes. Thus the arrangement of probes on the support is predetermined. Each probe (i.e each probe replicate) is located at a known predetermined position on the solid support such that the identity (i.e. the sequence) of each probe can be determined from its position in the array. Typically the probes are uniformly distributed in a predetermined pattern. Preferably, the probes deposited on the support, although they maintain a predetermined arrangement, are not grouped by genetic variation but have a random distribution. Typically they are also not grouped within the same genetic variation. If desired, this random distribution can be always the same. Therefore, typically the probes are deposited on the solid support (in an array) following a predetermined pattern so that they are uniformly distributed, for example, between the two areas that may constitute a DNA-chip, but not grouped according to the genetic variation to be characterised. Distributing probe replicates across the array in this way helps to reduce or eliminate any distortion of signal and data interpretation, e.g. arising from a non-uniform distribution of background noise across the array.

As explained above, probes may be arranged on the support in subarrays.

Microarrays are in general prepared by selecting probes which comprise a given polynucleotide sequence, and then immobilizing such probes to a solid support or surface. Probes may be designed, tested and selected as described herein. In general the probes may comprise DNA sequences. In some embodiments the probes may comprise RNA sequences, or copolymer sequences of DNA and RNA. The polynucleotide sequences of the probes may also comprise DNA and/or RNA analogues, or combinations thereof. For example, the polynucleotide sequences of the probes may be full or partial fragments of genomic DNA. The polynucleotide sequences of the probes may also be synthesized nucleotide sequences, such as synthetic oligonucleotide sequences. The probe sequences can be synthesized either enzymatically in vivo, enzymatically in vitro (e.g., by PCR), or non-enzymatically in vitro.

Microarrays or chips can be made in a number of ways. However produced, microarrays typically share certain characteristics. The arrays are reproducible, allowing multiple copies of a given array to be produced and easily compared with each other. Preferably, microarrays are made from materials that are stable under binding (e.g., nucleic acid hybridization) conditions. The microarrays are preferably small, e.g., between 0.25 to 25 or 0.5 to 20 $cm^2$, such 0.5 to 20 $cm^2$ or 0.5 to 15 $cm^2$, for example, 1 to 15 $cm^2$ or 1 to 10 $cm^2$, such as 2, 4, 6 or 8 $cm^2$.

Probes may be attached to the present support using conventional techniques for immobilization of oligonucleotides on the surface of the supports. The techniques used depend, amongst other factors, on the nature of the support used [porous (membranes, microparticles, nanoparticles, etc.) or non-porous (glass, plastic, silicone, etc.)] In general, the probes can be immobilized on the support either by using non-covalent immobilization techniques or by using immobilization techniques based on the covalent binding of the probes to the support by chemical processes.

Preparation of non-porous supports (e.g., glass, silicone, plastic) requires, in general, either pre-treatment with reactive groups (e.g., amino, aldehyde) or covering the surface of the support with a member of a specific binding pair (e.g. avidin, streptavidin). Likewise, in general, it is advisable to pre-activate the probes to be immobilized by means of corresponding groups such as thiol, amino or biotin, in order to achieve a specific immobilization of the probes on the support.

The immobilization of the probes on the support can be carried out by conventional methods, for example, by means of techniques based on the synthesis in situ of probes on the support (e.g., photolithography, direct chemical synthesis, etc.) or by techniques based on, for example, robotic arms which deposit the corresponding pre-synthesized probe (e.g. printing without contact, printing by contact).

In one embodiment, the support is a glass slide and in this case, the probes, in the number of established replicates (for example, 6, 8 or 10) are printed on pre-treated glass slides, for example coated with aminosilanes, using equipment for automated production of DNA-chips by deposition of the oligonucleotides on the glass slides ("micro-arrayer"). Deposition is carried out under appropriate conditions, for example, by means of crosslinking with ultraviolet radiation and heating (80° C.), maintaining the humidity and controlling the temperature during the process of deposition, typically at a relative humidity of between 40-50% and typically at a temperature of 20° C.

The replicate probes are distributed uniformly amongst the areas or sectors (sub-arrays), which typically constitute a DNA-chip. The number of replicas and their uniform distribution across the DNA-chip minimizes the variability arising from the printing process that can affect experimental results Likewise, positive and negative hybridisation controls (as described herein) may be printed.

To control the quality of the manufacturing process of the DNA-chip, in terms of hybridization signal, background noise, specificity, sensitivity and reproducibility of each replica as well as differences caused by variations in the morphology of the spotted probe features after printing, a commercial DNA can be used. For example, as a quality control of the printing of the DNA-chips, hybridization may be carried out with a commercial DNA (e.g. k562 DNA High Molecular Weight, Promega)

In the first place, the morphology and size of the printed spots are analyzed. In the hybridization with control DNA the parameters described below for determining reliability of genotype determination, are adhered to; specifically the relationship between the signal intensity and background noise, average or median specificity and sensitivity and reproducibility between replicated copies of the same probe. This method allows the correct genotype of the control DNA to be determined.

In contrast to chip DNA array technology in which the probes are attached to the solid support at known locations, particle suspension technology allows for the detection of probes in a single vessel, with individual probes attached to a particle with a distinguishable characteristic. In some embodiments the particles are encoded with one or more optically distinguishable dyes, a detectable label, or other identifying characteristic such as a bar code. Other labelling methods include but are not limited to a combination of fluorescent and non-fluorescent dyes, or avidin coating for binding of biotinylated ligands. Such methods of encoding particles are known in the art.

In one aspect of the invention the signal from the particles is detected by the use of a flow cytometer. In other embodiments, detection of fluorescent labels may also be carried out using a microscope or camera that will read the image on the particles. Flow cytometric software for detection and analysis of the signal is available for example from Luminex, Inc. (Austin, Tex.).

As above, in accordance with the present method, a nucleic acid sample, e.g. amplification or fragmentation products, comprising the genetic variation(s) to be detected (target DNA) is contacted with a probe array or suspension as described herein, under conditions which allow hybridisation to occur between target DNA and the corresponding probes. Specific hybridisation complexes are thus formed between target nucleic acid and corresponding probes.

The hybridization of e.g. fragmentation products, with probes capable of detecting corresponding genetic variations deposited on a support may be carried out using conventional methods and devices. In one instance, hybridization is carried out using an automated hybridisation station. For hybridization to occur, the e.g. fragmentation products, are placed in contact with the probes under conditions which allow hybridization to take place. Using stable hybridization conditions allows the length and sequence of the probes to be optimised in order to maximize the discrimination between genetic variations A and B, e.g. between wild type and mutant sequences, as described herein.

In one instance, the method relies on differential hybridisation, in particular an increase in hybridisation signal. The method involves formation of specific hybridisation complexes between target DNA and corresponding probes. Thus target DNA bearing the wild type sequence will hybridise to the probes designed to detect the wild type sequence, whereas target DNA bearing a mutant sequence will hybridise to the probes designed to detect that mutant sequence. The hybridisation complexes are detectably labelled by means described herein (e.g. the target DNA is directly labelled, or both target and probe are labelled in such a way that the label is only detectable on hybridisation). By detecting the intensity of detectable label (if any) at the predetermined probe positions it is possible to determine the nature of the target DNA in the sample. In this instance the probes (also referred to as allele specific oligonucleotides, ASOs) preferably have the variable nucleotide(s) at the central position, as described herein.

In another instance, hybridisation of target DNA to probes on the solid support may be followed by amplification, for example, using primer extension or ligation, e.g. oligonucleotide ligation assay (OLA) technologies (Eggerding F A, Iovannisci D M, Brinson E., Grossman P., Winn-Deen E. S. 1995 Human Mutation, 5:153-65). In this case, the probes on the support typically comprise the variable nucleotide(s) at the 3' end of the probe.

Labelling can be carried out during post hybridisation amplification. The labelling can be by direct labelling using, for example, fluorophores, enzymes, radioactive isotopes, etc. or by indirect labelling using, for example, specific binding pairs which incorporate fluorophores, enzymes etc., by using conventional methods, such as those previously mentioned in relation to labelling amplification or fragmentation products.

Post-hybridization amplification may be carried out, for example, using the "primer extension" methodology. Typically, after hybridization, an extension reaction of the hybrid oligonucleotides is carried out on the support (e.g. a glass slide). Extension may be carried out with directly or indirectly labelled nucleotides and will only happen if the extreme 3' of the oligonucleotide hybridizes perfectly with the amplification product.

Primer extension is a known method for genotype discrimination (Pastinen T, Raitio M, Lindroos K, Tainola P, Peltonen L, Syvanen A C. 2000 Genome Research 10:1031-42.) and can be performed in a number of different ways. In a commonly used approach a set of allele specific oligonucleotide probes are designed to hybridise to the target sequences. The probes differ from one another in their extreme 3' nucleotide, which for each probe is designed to complement one of the possible polymorphic nucleotides at a given position or on a particular species of microparticle.

When the 3' nucleotide of the probe complements the sequence under test then the ensuing base pairing allows a DNA polymerase to extend the oligonucleotide primer by incorporation of additional nucleotides that can be directly or indirectly labelled thereby allowing the subsequent identification of those probes that have been extended and those that have not. Probes that are successfully extended carry the complementary nucleotide to the SNP at their 3' end thus allowing the genotype of the test sample to be determined. Similar approaches, for example the Amplification Refractory Mutation System (ARMS) have also been developed.

Alternatively, a post hybridization ligation reaction may be carried out, for example using OLA methodology. After hybridization, a ligation reaction of the hybridised oligonucleotides is carried out on the support (e.g. glass slide) with labelled oligonucleotides. A ligation will only take place if the extreme 3' end of the probe deposited on the support hybridizes perfectly with the target DNA (e.g. amplification product).

The oligonucleotide ligation assay (OLA) is another method for interrogating SNPs (Eggerding F A, Iovannisci D M, Brinson E., Grossman P., Winn-Deen E. S. 1995 Human Mutation, 5:153-65). OLA uses a pair of oligonucleotide probes that hybridize to adjacent segments of target DNA including the variable base. The probe designed to hybridise to the 5' side of the polymorphic nucleotide is an allele-specific oligonucleotide (ASO) to one of the target alleles. The last base at the 3' end of this ASO is positioned at the site of the target DNA's polymorphism; the ASO typically also has a biotin molecule at its 5' end that functions as a "hook" that can subsequently be used to recover the oligonucleotide by virtue of the highly specific interaction that biotin undergoes with streptavidin.

The oligomer on the 3' or right-hand side of the pair is the common oligomer (the sequence is the same for the two or more different alleles it is wished to test.) The common oligomer is positioned at an invariable site next to the target DNA's polymorphism and is fluorescently labelled at its 3' end.

If the ASO is perfectly complementary to the target sequence the ASO hybridizes completely when annealed and will lie flat against that target allowing DNA ligase to covalently join the ASO to the common oligomer. After the ligation reaction the biotin hook is used to remove the ASO and the e.g. fluorescently labeled common oligomer will also be removed, producing detectable fluorescence.

When the ASO is not a perfect match to the target sequence hybridization is incomplete and the 3' base of the oligomer will not be base-paired to the target DNA thus preventing ligation. Under these circumstances when the biotin hook is used to remove the ASO, the common oligonucleotide will not be removed and therefore there is no detectable label, e.g. fluorescence, in the molecule removed.

To distinguish between two known alleles that differ by a single base, three oligonucleotides are necessary: Two are allele-specific oligonucleotides (ASOs) that differ from each other only in the single 3' terminal base; the first is complementary to one allele and the second is complementary to the second allele. The third oligonucleotide is complementary to the invariable sequence adjacent to the variant base.

Once hybridisation (and optionally post-hybridisation amplification) has taken place, the intensity of detectable label for each species of probe, either in a known probe position on a chip or a known species of particle (including control probes), can be determined. The intensity of the signal (the raw intensity value) is a measure of hybridisation at each probe.

The intensity of detectable label at each probe position on a DNA-chip or on each uniquely identifiable particle (each probe replica) may be determined using any suitable means. The means chosen will depend upon the nature of the label. In general an appropriate device, for example, a scanner, collects the image of the hybridized and developed DNA-chip. An image is captured and quantified. In the case of a particle suspension, the intensity of the detectable label can be measured for example by a flow cytometer. In one instance, e.g. where fluorescent labelling is used, after hybridization, (optionally after post-hybridization amplification or ligation) the hybridized and developed DNA-chip is placed in a scanner in order to quantify the intensity of labelling at the points where hybridization has taken place. Although practically any scanner can be used, in one embodiment a fluorescence confocal scanner is used. In this case, the DNA-chip is placed in the said apparatus and the signal emitted by the fluorophore due to excitation by a laser is scanned in order to quantify the signal intensity at the points where hybridization has taken place. Non-limiting examples of scanners which can be used according to the present invention, include scanners marketed by the following companies: Axon, Agilent, Perkin Elmer, etc.

Typically, in determining the intensity of detectable label at each probe position on a DNA chip or on each uniquely identifiable particle (i.e for each probe replica), account is taken of background noise, which is eliminated. Background noise arises because of non-specific binding to the probe array or suspension and may be determined by means of controls included in the array or suspension. Once the intensity of the background signal has been determined, this can be subtracted from the raw intensity value for each probe replica in order to obtain a clean intensity value. Typically the local background, based on the signal intensity detected in the vicinity of each individual feature is subtracted from the raw signal intensity value. This background is determined from the signal intensity in a predetermined area surrounding each feature (e.g. an area of X, Y or Z µm2 centred on the position of the probe).

The background signal is typically determined from the local signal of "blank" controls (solvent only). In many instances the device, e.g. scanner, which is used to determine signal intensities will provide means for determining background signal.

Thus, for example, where the label is a fluorescent label, absolute fluorescence values (raw intensity values) may be gathered for each probe replica and the background noise associated with each probe replica can also be assessed in order to produce "clean" values for signal intensity at each probe position.

Once the target DNA has been hybridised to the chip and the intensity of detectable label has been determined at the probe replica positions on the chip (the raw intensity values), it is necessary to provide a method (model) which can relate the intensity data from the chip to the genotype of the individual.

The inventors have found that this can be done by applying a suitable algorithm to the intensity data. The algorithm and computer software developed by the inventors allows analysis of the genetic variations with sufficient sensitivity and reproducibility as to allow use in a clinical setting. The algorithm uses three linear functions which characterise each of the three genotypes AA, AB and BB for a given genetic variation. The method generally involves collating the intensity values for all of the replicas of each probe, to calculate an average intensity value for each probe. Optionally, the raw intensity values for each replica may be amended to take account of background noise (to obtain a clean intensity value) before the intensity values for each of the replicas are collated.

In general, for a given genetic variation, analysis and interpretation of a chip using at least four probes comprises the following steps:

(a) providing the intensity of detectable label at each replica for each of at least four probes (probes 1, 2, 3 and 4) provided for detection of the genetic variation (the raw intensity value), wherein:

probe 1 detects (is capable of specifically hybridising to) genetic variation A (e.g. a normal allele), and probe 2 detects (is capable of specifically hybridising to) genetic variation B (e.g. a mutant allele);

probe 3 detects (is capable of specifically hybridising to) genetic variation A (e.g. a normal allele) and probe 4 detects (is capable of specifically hybridising to) genetic variation B (e.g. a mutant allele); and probes 1 and 2 form a first probe pair and probes 3 and 4 form a second probe pair;

(b) optionally amending the raw intensity value for each replica to take account of background noise, thus obtaining a clean intensity value;

(c) collating the (optionally clean) intensity values for each of the replicas of each probe and determining an average intensity value for each probe;

(d) calculating ratios 1 and 2 wherein:

$$\text{Ratio 1} = \frac{\text{average intensity value for probe 1}}{\text{average intensity value for probe 1} + \text{average intensity value for probe 2}}$$

and $$\text{Ratio 2} = \frac{\text{average intensity value for probe 3}}{\text{average intensity value for probe 3} + \text{average intensity value for probe 4}}$$

(e) inputting ratios 1 and 2 into each of three linear functions which characterise each of the three possible genotypes, AA, AB and BB, wherein:

Function 1 is the linear function that characterizes individuals with the genotype AA and consists of a linear combination of ratios 1 and 2;

Function 2 is the linear function that characterizes individuals with the genotype AB and consists of a linear combination of ratios 1 and 2;

Function 3 is the linear function that characterizes individuals with the genotype BB and consists of a linear combination of ratios 1 and 2;

the linear functions are formed by coefficients which accompany the variables ratio 1 and 2;

(f) determining which of the three linear functions has the highest value; and (g) thereby determining the genotype of the individual for the genetic variation.

Thus the linear function corresponding to the genotype of that individual will have the highest absolute value.

For analysis and interpretation of a particle array using at least four probes comprises the following steps:

(a) providing the intensity of detectable label at each replica for each of four probes (probes 1, 2, 3 and 4) provided for detection of the genetic variation (the raw intensity value), wherein:

probe 1 detects (is capable of specifically hybridising to) genetic variation A (e.g. a normal allele), and probe 2 detects (is capable of specifically hybridising to) genetic variation B (e.g. a mutant allele);

probe 3 detects (is capable of specifically hybridising to) genetic variation A (e.g. a normal allele) and probe 4 detects (is capable of specifically hybridising to) genetic variation B (e.g. a mutant allele); and probes 1 and 2 form a first probe pair and probes 3 and 4 form a second probe pair;

(b) optionally amending the raw intensity value for each replica to take account of background noise, thus obtaining a clean intensity value;

(c) collating the (optionally clean) intensity values for each of the replicas of each probe and determining an average intensity value for each probe;

(d) calculating ratios 1 and 2 wherein:

$$\text{Ratio 1} = \frac{\text{median intensity value for probe 1}}{\text{median intensity value for probe 1} + \text{median intensity value for probe 2}}$$

and $$\text{Ratio 2} = \frac{\text{median intensity value for probe 3}}{\text{median intensity value for probe 3} + \text{median intensity value for probe 4}}$$

(e) inputting ratios 1 and 2 into each of three linear functions which characterise each of the three possible genotypes, AA, AB and BB, wherein:
Function 1 is the linear function that characterises individuals with the genotype AA and consists of a linear combination of ratios 1 and 2;
Function 2 is the linear function that characterises individuals with the genotype AB and consists of a linear combination of ratios 1 and 2;
Function 3 is the linear function that characterises individuals with the genotype BB and consists of a linear combination of ratios 1 and 2;
the linear functions are formed by coefficients which accompany the variables ratio 1 and 2;
(f) determining which of the three linear functions has the highest value; and
(g) thereby determining the genotype of the individual for the genetic variation.

For analysis and interpretation of a particle suspension using two probes comprises the following steps:
(a) providing the intensity of detectable label at each replica for each of two probes (probes 1 and 2) provided for detection of the genetic variation (the raw intensity value), wherein:
probe 1 detects (is capable of specifically hybridising to) genetic variation A (e.g. a normal allele), and probe 2 detects (is capable of specifically hybridising to) genetic variation B (e.g. a mutant allele);
b) optionally amending the raw intensity value for each replica to take account of background noise, thus obtaining a clean intensity value;
(c) collating the (optionally clean) intensity values for each of the replicas of each probe and determining an average intensity value for each probe;
(d) calculating ratios 1 and 2 wherein:

$$\text{Ratio } 1 = \frac{\text{median intensity value for probe 1}}{\text{median intensity value for probe 1} + \text{median intensity value for probe 2}}$$

and $$\text{Ratio } 2 = \frac{\text{median intensity value for probe 2}}{\text{median intensity value for probe 1} + \text{median intensity value for probe 2}}$$

(e) inputting ratios 1 and 2 into each of three linear functions which characterize each of the three possible genotypes, AA, AB and BB, wherein:
Function 1 is the linear function that characterizes individuals with the genotype AA and consists of a linear combination of ratios 1 and 2;
Function 2 is the linear function that characterises individuals with the genotype AB and consists of a linear combination of ratios 1 and 2;
Function 3 is the linear function that characterises individuals with the genotype BB and consists of a linear combination of ratios 1 and 2;
the linear functions are formed by coefficients which accompany the variables ratio 1 and 2;
(f) determining which of the three linear functions has the highest value; and
(g) thereby determining the genotype of the individual for the genetic variation.

The inventors have found that the use of replicas and averages calculated from replicas is important for reliable working of the invention. Use of the functions speeds up analysis and allows better discrimination.

Preferably the discrimination capacity between the three genotypes is (approximately) 100%. If the discrimination is less than 100% the probes are preferably redesigned.

The raw intensity value for each probe replica may be determined according to the methods described above. Thus probe sequences and replicas can be selected as described herein. In one example, 4 probes are used per genetic variation and 6, 8 or 10 replicas are used per probe.

In some embodiments amending the raw intensity value to obtain the clean intensity value for each probe replica comprises subtracting background noise from the raw value. Background noise is typically determined using appropriate controls as described herein.

In some embodiments calculating the average intensity value comprises eliminating extreme values or outliers. Thus, when the (optionally clean) intensity values from each of the probe replicas are collated, outlying values can be identified and excluded from further consideration. In one embodiment outliers make up between 10% and 50%, for example, 15, 20, 25, 30, 35, 40 or 45% of the values obtained. In one embodiment, 40% of values are eliminated. In one embodiment, 4 probes are used with 6, 8 or 10 replicas per probe and extreme values or outliers make up between 10% and 50% of the values obtained.

A number of suitable linear functions are known in the art. These functions may be used in a linear discriminant analysis for the purposes of the present invention, such as the "Fisher linear function" or "Fisher linear discriminant function". A description of the Fisher linear function can be found at least in Fisher, "The Use of Multiple Measurements in Taxonomic Problems", Annals of Eugenics, 7: 179-188 (1936). The function is also described in expired provisional application Ser. No. 60/758,192, the contents of which are hereby incorporated by reference.

In one aspect the invention thus relates to a computational method or model (algorithm) for determining genotype with respect to a given genetic variation using ratios 1 and 2 in the three linear functions as defined above (steps e and f). The method can thus in one embodiment produce an output of genotype (AA, AB or BB) from an input of ratios 1 and 2. The method may also include calculating one or both of ratios 1 and 2 (step d). In some embodiments the method additionally comprises calculating an average intensity value for each probe (step c) and/or calculating a clean intensity value for each probe replica (step b). Thus the input to the model may comprise one or more of the average intensity values, clean replica intensity values or raw replica intensity values. The method may additionally comprise determining the raw intensity value for each probe replica (step a). The method may comprise one or more of the above steps.

In order to carry out the above methods, the coefficients for the linear functions must first be determined in a training process using data from control individuals whose genotype for the genetic variation is already known. Methods for training are known in the art. Typically in such methods, input data (in this case, typically ratios 1 and 2) is used for which the output (in the present case, genotype) is already known. Dependent variables are substituted in the three linear equations at random and the output is calculated. Based on that output, one or more dependent variables are altered and the input data is entered again to produce another output. The process is continued until dependent variables are obtained which optimise the desired output. These optimised dependent variables are then used in the linear functions when the method is applied to test data (where the output is as yet unknown).

In order to train the present model, ratios 1 and 2 are obtained for n control individuals having genotype AA (for example, homozygous wild type), n control individuals having genotype AB (heterozygous) and n control individuals having genotype BB (for example, homozygous mutant). The ratios may be obtained using the methods described above. The ratios are inputted as above and the dependent variables altered in a discriminatory analysis until three linear functions are obtained which maximise discrimination between the AA, AB and BB groups. These coefficients are then used in the three functions when the model is used on unknown test samples (where the genotype is not predetermined).

Thus in one aspect the invention provides a method of deriving linear functions for use in the present genotyping methods. The method typically comprises carrying out the steps of the genotyping methods as described, for n control individuals having genotype AA (for example, homozygous wild type), n control individuals having genotype AB (heterozygous) and n control individuals having genotype BB (for example, homozygous mutant) with respect to a genetic variation. The intensity values obtained for each of the probe replicas are gathered as described and an algorithm is applied.

As described for the genotyping methods, application of the algorithm comprises calculating an average intensity value for each probe and the algorithm uses three linear functions intended to characterise each of the three possible genotypes, AA, AB and BB for the given genetic variation. Coefficients are inserted in the functions in a repetitive way until functions are derived which maximise discrimination between the genotypes in a discriminatory analysis. This provides the coefficients for use in the linear functions when the method or algorithm is in operational use (i.e. to determine the genotype of test individuals).

The algorithm or method which uses the three linear functions for analysing the intensity data may be as described above.

In some cases, the training method allows feedback optimisation. Thus, as intensity values and ratios are obtained for test individuals and these are genotyped, the intensity data, e.g. the ratios, and genotype are inputted and coefficients recalculated for the linear functions.

In one aspect the invention relates to a computational method for training. The method can be used to derive linear functions for use in the present genotyping methods by using ratios 1 and 2 obtained for each of n individuals having genotype AA, n individuals having genotype AB and n individuals having genotype BB with respect to a genetic variation. The ratios can be obtained by the methods described above. The method typically comprises applying the algorithm which uses the three linear functions (Functions 1, 2 and 3) intended to characterise each of the three possible genotypes AA, AB or BB for the genetic variation such that:
Function 1 is the linear function that characterises individuals with the genotype AA and consists of a linear combination of ratios 1 and 2;
Function 2 is the linear function that characterises individuals with the genotype AB and consists of a linear combination of ratios 1 and 2;
Function 3 is the linear function that characterises individuals with the genotype BB and consists of a linear combination of ratios 1 and 2; and
the linear functions are formed by coefficients which accompany the variables ratio 1 and 2;

and deriving linear functions which maximise discrimination between the three genotype groups AA, AB and BB in a discriminatory analysis, so as to obtain the coefficients which can be used in the linear functions when the algorithm is used in a test method (i.e. is in operational use for determining genotype).

The algorithm or method which uses the three linear functions for analysing the intensity data may be as described above.

The computational training method may additionally involve calculating ratios 1 and 2 from average intensity value provided for each of the probes, and/or collating intensity values from probe replicas to determine an average intensity value for each probe and/or amending a raw intensity value for a probe replica to take account of background noise thereby obtaining clean intensity values for the replica.

In some aspects the computational method also allows a feedback optimisation step as described.

Typically in training n is $\geq 3$, for example, 3, 4, 5, 6, 7, 8, 9 or 10. In one aspect, n is $\geq 5$. In some cases n may be from 10 to 50 or more, for example, 15 to 40, or 25 to 35, such as 20 or 30.

Probes and probe replicas for the training method are selected as described herein. In one embodiment 4 probes are used for each genetic variation, with 6, 8 or 10 replicas of each probe. In another embodiment, 2 probes are used for each genetic variation. Once selected, the probes used in training are also used when the model is in operational use (to determine unknown genotype). If the probes are altered, typically the model must be retrained to optimise discrimination with the new probes.

Preferably the coefficients are such that the discrimination between the three genotype groups (both in training and in operational use) is substantially 100%. If the discrimination is not 100%, the probes are preferably redesigned.

As above, the model may also undergo feedback optimisation when it is in operational use. In that case, the model is first used to determine the genotype of an individual (AA, AB or BB). The ratios 1 and 2 for that individual are then inputted into the model and the coefficients in the linear functions altered as necessary in order to optimise discrimination between the three genotype groups. In this way, the additional data gathered as the model is in use can be used to optimise the discrimination capacity of the linear functions.

There are a number of parameters which can be determined and optimised in order to optimise performance and reliability of the analytical model or method.
(i) In one aspect ratios 1 and 2 determined for an individual fall within the range of ratios 1 and 2 used to train the model (i.e. to optimise the three linear functions). If desired this can thus provide a double test for the genotype of an individual.
(ii) In one aspect the average fluorescence intensity of 4n replicas (where "n" is the number of replicas for each probe, e.g. 6, 8 or 10), for example, 40 replicas, with regard to the background noise is greater than 5.
(iii) In one aspect the variation between intensity values (raw or clean) for replicas of the same probe is a minimum. For example, the coefficient of variation between the intensity values for the replicas of a given probe is preferably less than 0.25
(iv) In one aspect the ratio of the sum of the raw intensity values for all probe replicas on a chip to the intensity of the background noise is greater than 15 when a fluorescence scanner is used.
(v) In one aspect the raw signal intensity value obtained for the negative controls is $\leq 3$ times greater than the intensity value of the background noise. For example, negative controls may include the DMSO "blank" and the non-hybridising oligonucleotides referred to above. The background noise is the signal derived from the regions of the array where no probe has been spotted and may be determined as above.

Preferably any one or more of (i) to (v) applies when intensity is fluorescence intensity of a fluorescent label, in particular where the intensity is determined by means of a confocal fluorescent scanner or a flow cytometer.

Ensuring that the model meets one or more of the above helps to provide reliability and reproducibility. Any one or more of (i) to (v) may be true for the model. Preferably the model meets (i) above. In one example, (i), (ii) and (iii) are true. In another example, (iii), (iv), (v) are true. Preferably, all of the above are true for the model. This applies both to training and to operational use.

As above, the experimentally derived ratios obtained for a test sample may be compared to the ratios previously obtained for the (n) control samples obtained from individuals of known genotype, where n is as above, usually >5, or >10, or >20. The reference ratios derived from analysis of the control samples permits a genotype to be assigned to the test sample. This can therefore be a double test.

In one instance the analytical method or algorithm of the invention comprises a sequence of the following steps: using 4 probes (2 pairs of probes) in replicate (6, 8 or 10 replicas), calculating the average intensity of each probe from the collated intensities of the replicas; calculating ratios 1 and 2 as above for the 2 pairs of probes (to detect the genetic variations A and B); substituting ratios 1 and 2 obtained in three linear equations which have been derived in a discriminatory analysis using ratios 1 and 2 calculated for "n" control patients with genotype AA, "n" control patients with genotype AB and "n" control patients with genotype BB (with respect to the genetic variation) (in one experiment "n" is 5); and determining the genotype of a patient for the genetic variation (for each genetic variation included in the DNA array or suspension) based on which linear function has the greatest absolute value. The test ratios may also be compared to the ratios of the "n" control patients to determine each genotype.

In one aspect a genotyping method of the invention comprises:

extracting DNA from a biological sample provided by a subject;

amplifying the regions of the said nucleic acid which contain the genetic variations to be identified and as an option, labelling these products during the reaction of amplification in order to obtain several products of amplification, optionally labelled, which contain the genetic variations to be identified;

fragmenting the products of amplification to obtain several products of fragmentation which contain the genetic variations and if the said products have not been previously labelled during the amplification stage, labelling the products of fragmentation which contain the genetic variations to be identified;

hybridising the fragmentation products which contain the genetic variations to be identified with probes capable of identifying the genetic variations under conditions which allow hybridization to take place, wherein said probes are deposited on a support and for every genetic variation to be d, 4 probes are used following a determined pattern so that they are uniformly distributed but not grouped by genetic variation to be d, wherein of the 4 probes, 2 detect one genetic variation and the other two detect another and wherein the number of replicas of each one of the probes is 10, 8 or 6;

introducing the solid support into a scanner and quantifying the intensity of the points where hybridisation has occurred and;

genotyping each one of the genetic variants from the average of the collated intensities of the 10, 8 or 6 replicates of each one of the 4 probes, wherein extreme values are eliminated, by an algorithm developed for such a purpose that permits the detection of each one of the mutations with a sensitivity, specificity and reproducibility that permits this method to be used for clinical applications, based on the fact that it leads to obtaining three linear functions which each one of the possible genotypes.

The analysis and interpretation above has been described with respect to one genetic variation. However, it is to be understood that the present chip generally includes probes for detection of multiple genetic variations which can be analysed at the same time. Thus the present methods include analysis of multiple genetic variations, as described herein, in parallel.

In a further aspect the invention relates to a computer system comprising a processor and means for controlling the processor to carry out a computational method of the invention.

The invention additionally relates to a computer program comprising computer program code which when run on a computer or computer network causes the computer or computer network to carry out a computational method of the invention. The computer program may be stored on a computer readable medium.

The oligonucleotide primers according to the invention have the advantage of allowing specific amplification of the said target DNA regions in a very low number of PCR reactions. For example, in the case of detection of genetic variations associated with IBD, the primers allow, in a minimum number of multiplex PCR reactions, amplification of all the fragments necessary for genotyping of the genetic variations in Table 1, and which may be analyzed on an IBD array or suspension. In the case of the detection of genetic variations associated with adverse reactions to drugs the primers allow, in only 4 multiplex PCR reactions, amplification of 65 fragments necessary for genotyping of the 89 genetic variations in Table 3 which may be analyzed on a drug array or suspension. For a listing of exemplary primer sequences please see copending U.S. application Ser. No. 11/813,646.

In a further aspect, the present invention relates to each of the PCR primers and their use in PCR amplification, e.g. in a multiplex PCR reaction, of a target DNA region containing the corresponding genetic variation. The invention in one aspect provides any one of these primers or pairs of primers for use in medicine, in particular for use in the present genotyping, diagnostic or therapeutic methods.

The invention further relates to a PCR amplification kit comprising at least one pair of listed PCR primers. The kit may additionally include, for example, a (thermostable) polymerase, dNTPs, a suitable buffer, additional primers, and/or instructions for use, e.g. to amplify a target DNA region containing the corresponding genetic variation. The kit may be used for amplification of target DNA regions from nucleic acid samples, for use in the present methods.

In another aspect the present invention relates to a genotyping or diagnostic (preferably in vitro) kit comprising a DNA-chip or DNA particle suspension according to the invention. The kit may additionally comprise instructions for use of the chip in a genotyping method of the invention, for example instructions for use in the present analytical method or algorithm. Further components of a kit may include:

computer software, a computer program or a computer system according to the invention;

one or more PCR primers or pairs of PCR primers according to the invention; and/or a PCR amplification kit according to the invention.

The probes for the chip or PCR primers may be selected as above depending on the genetic variations to be detected or the diagnostic purpose of the kit.

The kit may contain one or more positive and/or negative controls of the hybridisation reaction.

The kit may be used to detect and analyse genetic variations associated with diseases or antigens of interest. Suitable probes may be designed accordingly.

In one aspect the kit is for detection or genotyping of genetic variations associated with known erythrocyte antigens, such as those described herein. The kit may therefore be useful in determining blood group type of an individual.

In another aspect the kit is for detection or genotyping of genetic variations associated with IBD, such as those described herein. The kit may therefore be useful in diagnosing IBD or susceptibility to IBD as described herein.

In a further aspect the genotyping kit is for detection or genotyping of genetic variations associated with adverse reactions to pharmaceuticals, such as those described herein. The kit may therefore be useful in diagnosing or predicting susceptibility to adverse reactions as described herein.

The invention further relates to the use of the kit in a genotyping, diagnostic or therapeutic method of the invention.

As described herein, the present methods are useful for diagnosing IBD in a patient or susceptibility to IBD in a patient. The present methods may be used to genotype an individual with respect to one or more genetic variations associated with IBD (e.g. those in Table 1). The results may be used to diagnose IBD or for prognosis and may be useful in determining the appropriate treatment for IBD (e.g. by predicting response to therapy).

IBD presents a number of phenotypes. For example, phenotypes observed in sufferers from Crohn's disease include the development of fistulae, perianal disease and clinically relevant extraintestinal manifestations, in addition some sufferers require surgical intervention (intestinal resection). Examples of disease phenotypes observed in sufferers from ulcerative colitis include pancolitis and clinically relevant extraintestinal manifestations, in addition surgical intervention may be required (colectomy).

Genetic data obtained from a Spanish trial of IBD chip (579 patients) has demonstrated a clear ability to predict the probability (high, moderate, low or minimal) of developing the abovementioned disease phenotypes in individuals suffering from Crohns disease and ulcerative colitis respectively based on their specific genetic profiles (see copending U.S. application Ser. No. 11/813,646).

Because of the aggressive nature of IBD, successful treatment often depends on individualising treatment regimens to fit each person's needs. Treatment typically includes controlling the active inflammation of the disease and maintaining remission through medication. The IBD chip is a genotyping tool that allows clinicians to evaluate the likely course of disease progression based on the individual genetic profiles of their patients as well as providing an indication of the most appropriate therapeutic interventions. A genotype predictive of a rapidly progressing and/or aggressive development of the disease will indicate the need for earlier and more closely monitored treatment regimes as well as indicating the probable need for surgical intervention. Conversely a genotype predictive of less severe disease progression may prevent the use of unnecessary treatment and/or surgery.

A wide range of drugs are been used to treat IBD sufferers including: aminosalysilates (e.g. sulfasalazine, olsalazine); antimetabolites (e.g. mercaptopurine, methotrexate); antirheumatics (e.g. azathioprine, 6-mercaptopurine) antibiotics (ciprofloxacin), biologics (e.g. infliximab); as well as a wide range of corticosteroid drugs. However, as discussed above the response of individual patient to these treatments can vary enormously and there is a clear clinical need for better methods of selecting the best therapeutic approach for IBD sufferers. Use of genetic data obtained from the use of IBD chip allowed the identification of individuals with varying probabilities (high, moderate, low and minimal) of developing resistance to corticosteroid treatment. The genotyping methodology described herein can be used to determine similar patterns relating to the genetic influence on drug response in similar clinical trials.

The present arrays and suspensions and methods thus provide a means for clinicians to predict the likely course of disease progression in individual patients and also aid in the selection of the most suitable treatment regime including the likelihood of the need for surgical intervention. They are therefore useful prognostic tools. Genotype information obtained according to the present invention may aid in clinical decision making or diagnosis in cases where symptoms (disease phenotype) are ambiguous. Genetic information provided by IBD-chip or suspension or other methods could also help in determining the likelihood of disease development in asymptomatic individuals (e.g. immediate family members of IBD sufferers) allowing for example guidance on lifestyle and diet to be provided and indicating the need for continued monitoring of individuals who have a genetic constitution that indicates possible susceptibility to disease development.

In one aspect the invention therefore relates to a method of diagnosing IBD or susceptibility to IBD in an individual, or determining the likely course of disease progression in an individual as above. Preferably the method is in vitro. The invention further relates to a method of selecting a treatment, e.g. determining the need for surgical intervention for an individual having IBD, in some cases where the individual has been diagnosed or tested according to the methods of the invention. Still further the invention in some aspects relates to methods of treating an individual suffering from IBD, wherein, after the treatment is selected, the treatment is administered to the individual.

Particular genetic variations associated with IBD may be predictive of particular phenotypes or development of particular phenotypes and hence disease progression. In other words, it may be that there is a statistically significant association between e.g. the mutant allele B, of a given genetic variation and the occurrence/development of a particular phenotype.

Since the present genotyping methods allow reliable genotyping of multiple genetic variations in a clinical setting, these can be used to genotype individuals of known IBD phenotype, and to thus identify genetic variations predictive of particular IBD phenotypes.

In one aspect the invention therefore relates to a method of identifying genetic variations predictive of a particular IBD phenotype, such as the phenotypes listed above. The method involves genotyping a plurality of individuals with respect to one or more genetic variations using a method of the invention, in which the genetic variations are associated with IBD. Typically 300-1000 individuals are genotyped, for example 400, 500 or 600 individuals may be genotyped. The IBD phenotype of each individual is already known. IBD phenotype may be determined by any appropriate method, e.g. the Vienna Classification (Gasche C, Scholmerich J, Brynskov J, et al. A simple classification of Crohn's disease: report of the Working Party for the World Congresses of Gastroenterology, Vienna 1998. Inflamm Bowel Dis 2000; 6: 8-15) or the Montreal Classification (Silverberg M S, Satsangi J, Ahmad T, Arnott I D, Bernstein C N, Brant S R, Caprilli R, Colombel J F, Gasche C, Geboes K, Jewell D P, Karban A, Loftus Jr E V, Pena A S, Riddell R H, Sachar D B, Schreiber S, Steinhart A H, Targan S R, Vermeire S, Warren B F. Toward an integrated clinical, molecular and serological classification of inflammatory bowel disease: Report of a Working Party of the 2005 Montreal World Congress of Gastroenterology. Can J Gastroenterol. 2005 September; 19 Suppl A:5-36).

Once the genotypes are obtained, this data is compared with the phenotype data and statistically significant associations between particular genotypes and particular phenotypes are identified. Methods for determining statistical significance are known in the art.

The genetic variations identified as predictive of particular phenotypes/disease course can then be used to diagnose these phenotypes/disease courses in test individuals, by genotyping the individuals with respect to the predictive genetic variation(s). Thus it is possible to determine the likely course of disease progression in the individual. Genotyping can be done by any appropriate method, depending on the number of variations to be tested. For example, a genotyping method of the invention may be used. Alternatively, sequence based or other chip- or particle-based methods may be appropriate.

Thus in one aspect the invention further relates to a method of diagnosing IBD phenotype or predicting the likely course of disease progression in an individual by determining the genotype of the individual with respect to one or more genetic variations which have been identified as predictive (of the particular IBD phenotype or disease course) by the methods described herein.

Once the prediction has been made, it will then be possible to select the most suitable therapeutic approach, e.g. to determine the need for surgical intervention.

The invention is also useful in determining the blood group of an individual by determining genotype with respect to one or more particular erythrocyte associated antigens (e.g. those in Table 2). Therefore in a further aspect the invention relates to a method (in one aspect in vitro) of determining blood group or type in an individual. Such methods may be useful in for example, blood transfusions, organ transplantation, medical-legal applications or treatment of haemolytic disease of the fetus and new born.

The invention is further useful in determining the likelihood of an adverse reaction to pharmaceuticals in an individual. Therefore in a further aspect the invention relates to a method (in one aspect in vitro) of diagnosing or predicting susceptibility to adverse reaction to pharmaceuticals in an individual. The method comprises determining the genotype of an individual with respect to one or more genetic variations associated with adverse reaction to pharmaceuticals (e.g. those in Table 3) by the present genotyping methods. The genotyping results may be used to select a treatment for the individual which can then be administered. Thus in some aspects the invention further relates to methods of selecting a pharmaceutical treatment for an individual, and methods of treating an individual with the selected pharmaceutical.

The diagnostic, predictive and therapeutic methods comprise carrying out a genotyping method of the invention as described herein. Any of the methods may involve carrying out a training method of the invention as described herein in order to derive linear functions for use in determining genotype. Further the methods may comprise the use of a chip, a plurality of beads or other particles, computer system, computer program, oligonucleotide probes or pair or set of probes, oligonucleotide primer or pair of primers, PCR amplification kit or diagnostic kit of the invention as described herein.

EXAMPLES

Although in general, the techniques mentioned herein are well known in the art, reference may be made in particular to Sambrook et al, 1989, Molecular Cloning: a laboratory manual.

Example 1

Detection of Human Genetic Variations Associated with Dombrock, Using a Bead DNA Particle Suspension for the Identification of this Human Blood Group 1.1 Design of the Bead Suspension for Genotyping Blood Groups A bead DNA suspension was designed and produced to detect human genetic variations associated with the erythrocyte antigen, Dombrock, which allows the simultaneous, sensitive, specific and reproducible detection of the genetic variations. In this case, the particle suspension designed and produced consisted of a suspension buffer containing a plurality of beads with probes coupled on the surface. These probes were capable of hybridizing with (amplified) target gene sequences that encoded Dombrock, the erythrocyte antigen being studied. The DNA sequences of the probes used are listed below. In general, the name of the gene, the mutation (nucleotide change, "ins": insertion "del": deletion), the genotype and the exon are indicated.

| DOMBROCK A793G GENOTYPE: DOMBROCK DOa/DOb EXON2 | | |
|---|---|---|
| SEQ ID NO 619 | ACTGCAACCAGTTTCCTCTTGGGTG | 25 |
| SEQ ID NO 620 | ACTGCAACCAGTCTCCTCTTGGGTG | 25 |
| SEQ ID NO 1656 | CTGCAACCAGTTTCCTCTTGGGT | 23 |
| SEQ ID NO 1657 | CTGCAACCAGTCTCCTCTTGGGT | 23 |

1.2 Production of the Bead Suspension for Genotyping Blood Groups: Processing of the Coupled Beads The probes capable of detecting the genetic variations previously identified were coupled with 4 different types of beads in a chemical reaction.

The coupling of the probes to the beads was carried out by means of chemical reaction between carboxyl and amino group as described in the documentation provided by the manufacturer (for example, Luminex available on the World Wide Web at luminexcorp.com).

1.3 Validation of the Clinical Usefulness of the Bead Suspension to Identify the Human Blood Group, Dombrock: Simultaneous, Sensitive, Specific and Reproducible Detection of Human Genetic Variations Associated with Dombrock 1.3.1 Preparation of the Sample to be Hybridized The DNA of the individual was extracted from a blood sample by a standard protocol of filtration. (For example, commercial kits from Macherey Nagel, Qiagene etc).

The exon of interest was amplified by multiplex PCR using appropriate pairs of oligonucleotide primers. Oligonucleotide primers useful for carrying out PCR multiplex for the detection of genetic variations associated with human erythrocyte antigens can be designed by those skilled in the art using the corresponding gene sequences as described in GenBank with, for example, the software: Primer 3 (available on the World Wide Web at frodo.wi.mit.edu/cgi-bin/primer3/primer3) or Web Primer (available on the World Wide Web at seq.yeastgenome.org/cgi-bin/web-primer). Practically any pair of oligonucleotide primers can be used that permit the specific amplification of genetic fragments where a genetic variation to be detected may exist. Where possible, those pairs of oligonucleotide primers which allow the said amplifications to be performed in the least possible number of PCR reactions are used. In this case, primers were selected which permitted, in only 1 PCR reaction, amplification of the fragment necessary for genotyping the genetic variations previously mentioned using the bead suspension for detection of genetic variations associated with the erythrocyte antigen, Dombrock.

The PCR reaction was carried out under the conditions of time and temperature which permitted specific amplification of the gene fragment comprising the genetic variations to be detected. During the PCR reaction a biotin nucleotide is incorporated.

Following multiplex PCR, agarose gel analysis was used to check that the amplification reaction had taken place.

Before applying the sample to the bead suspension, the sample was denatured by heating to 95° C. for 5 minutes and following the denaturalization. The sample was then applied and hybridized to the bead suspension.

1.3.2 Hybridization

Hybridization is carried out in a thermocycler at 52° C. for 15 minutes.

Once the process of hybridization has finished, the plate is washed once with a cleaning buffer.

When hybridization has taken place, the bead suspension is developed by incubation with a fluorescently labelled molecule that is able to specifically bind to the molecule incorporated into the amplification product (e.g. in the case of biotin incorporation a fluorophore coupled to streptavidin such as streptavidin-phycoerthrine can be used) to label the probe positions where hybridization has occurred.

1.3.3. Scanning the Hybridized Coupled Beads

The hybridized coupled beads are placed in a fluorescent laser cytometer, and the signal emitted by the fluorophore is scanned when stimulated by the laser.

1.3.5 Interpretation of the Results: Determination of the Genotype of the Individual, Regarding the Human Genetic Variations Associated with the Human Erythrocyte Antigen, Dombrock, and the Identification of the Blood Group of the Individual.

From the signal obtained with the probes which detect the different genetic variations, the genotype of the individual is established. In the first instance the scanner software executes a function to subtract the local background noise from the absolute signal intensity value obtained for each probe. Next, the replicates for each of the 4 probes that were used to characterize each genetic variation were grouped. The median intensity value for each of 4 probes was calculated using the median collated from the replicates in order to identify abnormal values (outliers) that can be excluded from further consideration. Once the median intensity value for each of the probes was known then two ratios are calculated (ratio 1 and ratio 2):

$$-\text{Ratio } 1 = \frac{\text{Median intensity for probe } 1}{\text{Median intensity for probe } 1 + \text{Median intensity for probe } 2}$$

$$-\text{Ratio } 2 = \frac{\text{Median intensity for probe } 3}{\text{Median intensity for probe } 3 + \text{Median intensity for probe } 4}$$

wherein probe 1 detects (is capable of specifically hybridising to) genetic variation A (e.g. a normal allele), probe 2 detects (is capable of specifically hybridising to) genetic variation B (e.g. a mutant allele), probe 3 detects (is capable of specifically hybridising to) genetic variation A (e.g. a normal allele) and probe 4 detects (is capable of specifically hybridising to) genetic variation B (e.g. a mutant allele).

These ratios are substituted in three linear functions which characterize each one of the three possible genotypes:

AA Function 1
AB Function 2
BB Function 3

The function which presents the highest absolute value determines the genotype of the patient.

The linear functions are obtained by analyzing 18 subjects for each of the three possible genotypes of the genetic variation (AA, AB, BB). With the results, ratios 1 and 2 were calculated for the 54 subjects. These ratios are classification variables for the three groups to create the linear functions, with which the discriminatory capacity of the two pairs of designed probes was evaluated. If the discriminatory capacity is not 100%, the probes are redesigned. New subjects characterized for each of the three genotypes make up new ratios 1 and 2 to perfect the linear functions and in short, to improve the discriminatory capacity of the algorithm based on these three functions.

When using a fluorescent laser, to obtain reliable results it is preferable that ratios 1 and 2 are within the range of the ratios used to build the groups.

In this case 4 probes are presented in the beads suspension for detection of each mutation. Two of the probes detect one genetic variation (A) and the other two the other genetic variation (B). The examined base is located in the central position of the probes.

A subject homozygous for the genetic variation A will not show genetic variation B. Consequently, the probes which detect genetic variation B will show a hybridization signal significantly less than that shown by variation A and vice versa. In this case the ratios 1 and 2 will show 1 and the subjects will be assigned as homozygous AA by the software analysis.

Alternatively, a heterozygous subject for the determined genetic variation shows both the genetic variations. Therefore, the probes which detect them show an equivalent hybridization signal. The ratios 1 and 2 will show 0.5 and the subject will be assigned as heterozygous AB by the software analysis.

Example 2

Identification of the Blood Group of 54 Individual Blood Donors, Using the Bead Suspension for the Genotyping of Blood Groups 2.1 DNA Extraction DNA was extracted from 54 blood donors by conventional methods. Genetic analysis by genotyping the region of interest in the planar array, Bloodchip v1.0 (www.progenika.com), confirmed that 18 of the donors had genotype domA domA, another 18 donors had genotype domA domB and the remaining 18 had genotype domB domB.

2.2 Probe Design 4 probes were designed for the detection of the polymorphism Dom A793G/A793G genotype Dombrock as previously described (Example 1):

```
SEQ ID NO 619    ACTGCAACCAGTTTCCTCTTGGGTG    25

SEQ ID NO 620    ACTGCAACCAGTCTCCTCTTGGGTG    25

SEQ ID NO 1656   CTGCAACCAGTTTCCTCTTGGGT      23

SEQ ID NO 1657   CTGCAACCAGTCTCCTCTTGGGT      23
```

2.3 Production of the Bead Suspension for Genotyping Blood Groups: Processing of the Coupled Beads.

The designed probes were coupled with 4 different types of beads in a chemical reaction as described in Example 1.2.

2.4 PCR and Labelling the Sample

The region of the Dombrock gene for the analysis of the genetic variation of interest (Dom A793G genotype Dombrock) was amplified by means of PCR multiplex using specific primers. The product of the amplification was labelled as described in Example 1.3.1.

2.5 Hybridization of the Samples

Hybridization was carried out in a thermocycler, as described in Example 1.3.2.

2.6 Analysis of the Results

The beads hybridized were placed in the cytometer. The signal emitted by the bound fluorophore on excitation by the laser was measured (Example 1.3.3) and the image obtained from the signal at the points where hybridization had taken place was quantified (Example 1.3.4).

The analysis of the results was carried out using the algorithm previously described in Example 1.3.5. The algorithm allowed characterization of this genetic variation for the 54 subjects with a coincidence of 100% compared to the genetic variation obtained in the planar array, Bloodchip v1.0.

FIG. 1 shows the representation of ratios 1 and 2 and allows characterization of the 54 patients.

Example 3

Detection of Human Genetic Variations Associated with Human Platelet Antigens, Using a Bead Suspension for the Identification of this Human Blood Group 3.1 Design of the Bead Suspension for Genotyping Blood Groups A bead suspension was designed and produced to detect human genetic variations associated with the following human platelet antigens: HPA-1, HPA-5, HPA-6 and HPA-15; which allows the simultaneous, sensitive, specific and reproducible detection of the genetic variations.

The bead suspension designed and produced consists of a suspension buffer, which comprises a plurality of coupled beads with probes on its surface, which allows the detection of the genetic variations. These probes are capable of hybridizing with (amplified) target gene sequences that encode the human platelet antigens to be studied. The DNA sequences of the probes used in this example are listed below. In general, the name of the gene, the mutation (nucleotide change, "ins": insertion "del": deletion), the genotype and the exon are indicated.

For each variation four probes were used. For HPA-1, HPA-6, and HPA-15, one probe pair was provided in duplicate. The duplicate probes were from different production batches. For HPA-5, two probe pairs were used.

| HPA-1 ITGB3 T176C GENOTYPE: HPA-1 HPA-1a/1b EXON3 | | |
|---|---|---|
| SEQ ID NO 1658 | GAGGTGAGCCCAGAGGCAGGGCC | 23 |
| SEQ ID NO 1659 | GAGGTGAGCCCGGAGGCAGGGCC | 23 |
| HPA-5 ITGA2 G1600A GENOTYPE: HPA-5 HPA-5a/1b EXON13 | | |
| SEQ ID NO 1660 | TTTTTTTTACCTCTTTGATAGTAAA | 25 |
| SEQ ID NO 1661 | TTTTTTTTACCTTTTTGATAGTAAA | 25 |
| SEQ ID NO 1662 | TTTTTTTACCTCTTTGATAGTAA | 23 |
| SEQ ID NO 1663 | TTTTTTTACCTTTTTGATAGTAA | 23 |
| HPA-6 ITGB3 G1544A GENOTYPE: HPA-6 HPA-6a/1b EXON10 | | |
| SEQ ID NO 1664 | GGCTGACCCTCCCGGGGCTGCA | 23 |
| SEQ ID NO 1665 | GGCTGACCCTCCTGGGGCTGCA | 23 |
| HPA-15 CD109 C2108A GENOTYPE: HPA-15 HPA-15a/1b EXON19 | | |
| SEQ ID NO 1666 | TGGTAAATCCTGTAACTGAAGTCAA | 25 |
| SEQ ID NO 1667 | TGGTAAATCCTGGAACTGAAGTCAA | 25 |

3.2 Production of the Probe Suspension for Genotyping Blood Groups: Processing of the Coupled Beads The probes capable of detecting the genetic variations previously identified are coupled with 16 different types of beads in a chemical reaction.

The coupling of the 16 probes to the 16 beads is carried out by means of chemical reaction between carboxyl and amino group as described in the documentation provided by the manufacturer (Luminex http://www.luminexcorp.com).

3.3 Validation of the Clinical Usefulness of the Bead Suspension to Identify the Human Platelet Antigens: HPA-1, HPA-5, HPA-6 and HPA-15: Simultaneous, Sensitive, Specific and Reproducible Detection of Human Genetic Variations Associated with these Human Platelet Antigens 3.3.1 Preparation of the Sample to be Hybridized The DNA of the individual is extracted from a blood sample by a standard protocol of filtration. (For example, commercial kits from Macherey Nagel, Qiagene etc).

The exons of interest are amplified by multiplex PCR using appropriate pairs of oligonucleotide primers. Oligonucleotide primers useful for carrying out PCR multiplex for the detection of genetic variations associated with the human platelet antigens can be designed by those skilled in the art using the corresponding gene sequences as described in GenBank with, for example, the software: Primer 3 (http://frodo.wi.mit.edu/cgi-bin/primer3/primer3_www.cgi) or Web Primer (http://seq.yeastgeneome.org/cgi-bin/web-primer). Practically any pair of oligonucleotide primers can be used that permit the specific amplification of genetic fragments where a genetic variation to be detected may exist. Where possible, those pairs of oligonucleotide primers which allow the said amplifications to be performed in the least possible number of PCR reactions are used.

In this case, primers are selected which permit, in only 1 PCR reaction, amplification of the fragments necessary for genotyping the genetic variations previously mentioned using the bead suspension for detection of genetic variations associated with the human platelet antigens: HPA-1, 5, 6 and 15.

The PCR reaction is carried out under the conditions of time and temperature which permit specific amplification of the gene fragments in which the genetic variations to be detected can exist. During the PCR reaction a biotin nucleotide is incorporated. Once the PCR multiplex has finished, agarose gel analysis is used to check that the amplification reaction has taken place.

Before applying the sample to the probe suspension, the sample is denatured by heating to 95° C. for 5 minutes and following the denaturalization then the hybridization process starts.

3.3.2 Hybridization

The probe suspension composed of 16 beads coupled with 16 different probes is distributed in the plate. The product PCR biotinylated is also distributed in the plate. Hybridization is carried out in a thermocycler at 52° C. for 15 minutes.

Once the process of hybridization has finished, the plate is washed once with a cleaning buffer.

When hybridization has taken place, the bead suspension is developed by incubation with a fluorescently labelled molecule that is able to specifically bind to the molecule incorporated into the amplification product (e.g. in the case of biotin incorporation a fluorophore coupled to streptavidin such as streptavidin-phycoerthrine can be used) to label the probe positions where hybridization has occurred.

3.3.3. Scanning the Hybridized Coupled Beads

The hybridized coupled beads are placed in a fluorescent laser cytometer, and the signal emitted by the fluorophore is scanned when stimulated by the laser.

3.3.5 Interpretation of the Results: Determination of the Genotype of the Individual, Regarding the Human Genetic Variations Associated with the Human Platelet Antigens, HPA-1, 5, 6 and 15, and the Identification of the Blood Group of the Individual.

From the signal obtained with the probes which detect the different genetic variations, the genotype of the individual is established. In the first instance the cytometer software executes a function to subtract the local background noise from the absolute signal intensity value obtained for each probe. Next, the replicates for each of the 4 probes that are used to characterize each genetic variation are grouped. The median intensity value for each of 4 probes is calculated using the median collated from the replicates in order to identify abnormal values (outliers) that can be excluded from further consideration.

Once the median intensity value for each of the probes is known then two ratios are calculated (ratio 1 and ratio 2).

In some cases, two unique probes (one probe pair) are used for each genetic variation: probe 1 (normal 1) and probe 2 (variant 2). In this case ratios 1 and 2 are calculated as follows:

$$\text{Ratio } 1 = \frac{\text{Median intensity for probe 1}}{\text{Median intensity for probe 1} + \text{Median intensity for probe 2}}$$

and $$\text{Ratio } 2 = \frac{\text{Median intensity for probe 2}}{\text{Median intensity for probe 1} + \text{Median intensity for probe 2}}$$

wherein probe 1 detects (is capable of specifically hybridising to) genetic variation A (e.g. a normal allele), probe 2 detects (is capable of specifically hybridising to) genetic variation B (e.g. a mutant allele). In this case the 4 probes comprise two of probe 1 and two of probe 2. In some embodiments the duplicate probes are from different production batches.

In some cases, four unique probes (two probe pairs) are used for each genetic variation: probe 1 (normal 1), probe 2 (variant 2), probe 3 (normal 3) and probe 4 (variant 4). In this case ratios 1 and 2 are calculated as follows:

$$\text{Ratio } 1 = \frac{\text{Median intensity for probe 1}}{\text{Median intensity for probe 1} + \text{Median intensity for probe 2}}$$

and $$\text{Ratio } 2 = \frac{\text{Median intensity for probe 3}}{\text{Median intensity for probe 3} + \text{Median intensity for probe 4}}$$

wherein probe 1 detects (is capable of specifically hybridising to) genetic variation A (e.g. a normal allele), probe 2 detects (is capable of specifically hybridising to) genetic variation B (e.g. a mutant allele), probe 3 detects (is capable of specifically hybridising to) genetic variation A (e.g. a normal allele) and probe 4 detects (is capable of specifically hybridising to) genetic variation B (e.g. a mutant allele).

These ratios are substituted in three linear functions which characterize each one of the three possible genotypes:

| | |
|---|---|
| AA | Function 1 |
| AB | Function 2 |
| BB | Function 3 |

The function which presents the highest absolute value determines the genotype of the patient. Since ratios 1 and 2 are obtained for the 4 human platelet antigens, three linear functions are obtained for each of the 4 human platelet antigens.

In this case, the linear functions are obtained by analyzing 10 subjects for each of the three possible genotypes of the genetic variation (AA, AB, BB). With the results, ratios 1 and 2 are calculated for the 4 human platelet antigens analyzed and for the 30 subjects. These ratios are classification variables for the three groups to create the linear functions, with which the discriminatory capacity of the two pairs of designed probes is evaluated. If the discriminatory capacity is not 100%, the probes are redesigned. New subjects d for each of the three genotypes make up new ratios 1 and 2 to perfect the linear functions and in short, to improve the discriminatory capacity of the algorithm based on these three functions.

To obtain reliable results when using a fluorescent laser it is preferable that ratios 1 and 2 are within the range of the ratios used to build the groups. In summary, in this example 4 probes are presented in the bead suspension for detection of each mutation. Two of the probes detect one genetic variation (A) and the other two the other genetic variation (B). The examined base is located in the central position of the probes.

A subject homozygous for the genetic variation A will not show genetic variation B. Consequently, the probes which detect genetic variation B will show a hybridization signal significantly less than that shown by variation A and vice versa. In this case the ratios 1 and 2 will equal 1 and the subjects will be assigned as homozygous AA by the software analysis.

On the other hand, a subject heterozygous for the determined genetic variation shows both the genetic variations. Therefore, the probes which detect them show an equivalent hybridization signal. The ratios 1 and 2 will show equal 0.5 and the subject will be assigned as heterozygous AB by the software analysis.

Example 4

Identification of the Blood Group of 9 Individual Blood Donors, Using the Bead Suspension for the Genotyping of Human Platelet Antigens 4.1 DNA Extraction DNA was extracted from 9 blood donors by conventional methods. Genetic analysis by genotyping the region of interest in the planar array, Bloodchip v2.0 (www.progenika.com), confirmed that 3 of the donors had genotype HPA-1a/1a, HPA-5a/5a, HPA-6a/6a and HPA-15a/15a, another 3 donors had genotype HPA-1b/1b, HPA-5b/5b, HPA-6b/6b and HPA-15b/15b and the remaining 3 had genotype HPA-1a/1b, HPA-5a/5b, HPA-6a/6b and HPA-15a/15b.

4.2.1 Probe Design 4 probes were designed for the detection of the polymorphism HPA-1 T176C genotype HPA-1 as previously described (Example 3):

```
SEQ ID NO 1658    GAGGTGAGCCCAGAGGCAGGGCC        23
SEQ ID NO 1659    GAGGTGAGCCCGGAGGCAGGGCC        23
```

4 probes were designed for the detection of the polymorphism HPA-5 G1600A genotype HPA-5 as previously described (Example 3):

```
SEQ ID NO 1660    TTTTTTTTACCTCTTTGATAGTAAA      25
SEQ ID NO 1661    TTTTTTTTACCTTTTTGATAGTAAA      25
SEQ ID NO 1662    TTTTTTTACCTCTTTGATAGTAA        23
SEQ ID NO 1663    TTTTTTTACCTTTTTGATAGTAA        23
```

4 probes were designed for the detection of the polymorphism HPA-6 G1544A genotype HPA-6 as previously described (Example 3):

```
SEQ ID NO 1664    GGCTGACCCTCCCGGGGCTGCA         25
SEQ ID NO 1665    GGCTGACCCTCCTGGGGCTGCA         25
```

4 probes were designed for the detection of the polymorphism HPA-15 C2108A genotype HPA-15 as previously described (Example 3):

```
SEQ ID NO 1666    TGGTAAATCCTGTAACTGAAGTCAA      25
SEQ ID NO 1667    TGGTAAATCCTGGAACTGAAGTCAA      25
```

4.2.2 Primer Design for HPA-5

2 primers were designed for efficient amplification of HPA-5:

```
SEQ ID NO 1668 HPA 5   GCCGCGAATTCACTAGTGTCTTGGTAGGT
                       GCACCAATGT
```

-continued
```
SEQ ID NO 1669 HPA 5   GGCCGCGGGAATTCGATTGATGAAATGTA
                       AACCATACTATCTGTGC
```

4.3 Production of the Bead Suspension for Genotyping Blood Groups: Processing of the Coupled Beads.

The designed probes are coupled with 16 different types of beads in a chemical reaction as described in Example 3.2.

4.4 PCR and Labelling the Sample.

The region of the HPA gene for the analysis of the genetic variation of interest (HPA-1 T176C genotype HPA-1, HPA-5 G1600A genotype HPA-5, HPA-6 G1544A genotype HPA-6, HPA-15 C2108A genotype HPA-15) was amplified by means of PCR multiplex using specific primers. The product of the amplification is labelled as described in Example 3.3.1.

4.5 Hybridization of the Samples

Hybridization was carried out in a thermocycler, as described in Example 3.3.2.

4.6 Analysis of the Results

The beads hybridized were placed in the cytometer. The signal emitted by the bound fluorophore on excitation by the laser was measured (Example 3.3.3) and the image obtained from the signal at the points where hybridization had taken place was quantified (Example 3.3.4).

The analysis of the results was carried out using the algorithm previously described in Example 3.3.5. The algorithm allowed characterization of this genetic variation for the 9 subjects with a coincidence of 100% compared to the genetic variation obtained in the planar array, Bloodchip v2.0.

Figure 2:
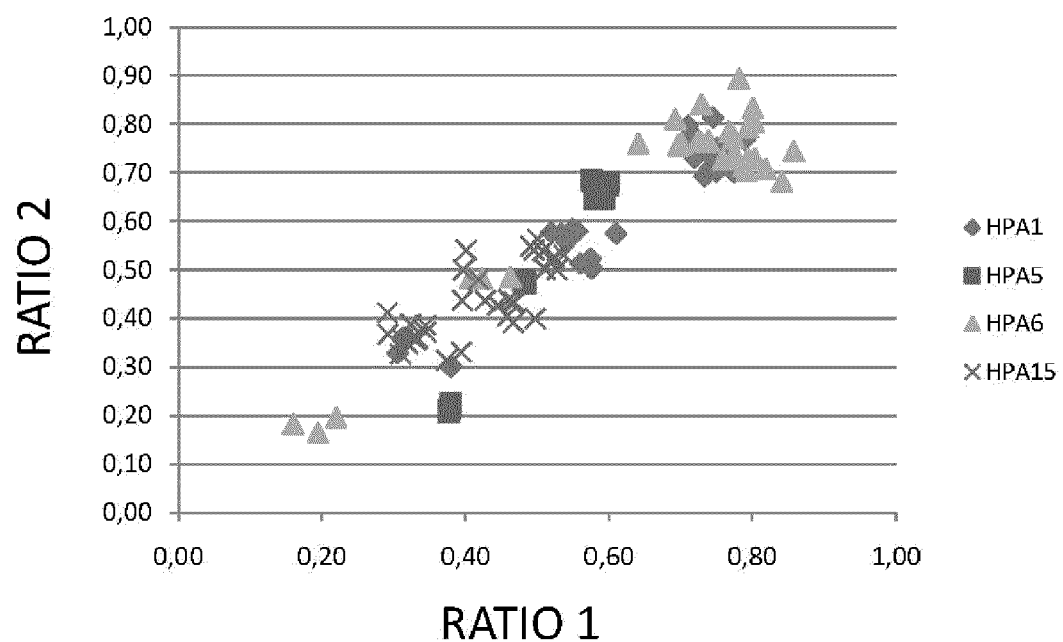
FIG. 2 shows the representation of ratios of 1 and 2 for the 4 human platelet antigens determinations and allows characterization of 9 blood donors.

FIG. 2 shows the representation of ratios 1 and 2 for the 4 human platelet antigens determinations and allows characterization of the 9 patients.

Example 5

Allele Determination

In some embodiments it is advantageous using the methods of the invention to identify known alleles of genes, wherein an "allele" can be used to predict a phenotype in a subject. An allele call can be made by identifying the haplotype, or collective variations, for a gene wherein the collective variations or allele is known to correspond to a particular phenotype. For example, a number of alleles for the Cytochrome P450 2D6 (CYP2D6), a member of the cytochrome P450 mixed-function oxidase system, are associated with a gene product with either increased or decreased enzyme activity. For instance, a homozygous mutation in the CYPD2D6 SNP 4180G>C and in the SNP 2850C>T, but not in the other known SNPs in the gene and no hybridisation in the duplication and deletion probes, will give a CYP2D6 *2/*2 allele call (*2 being the designation of an allele with increased enzyme activity) whereas a heterozygous mutation in the in the SNP 4180G>C and in the SNP 2850C>T but not in the others will result in a CYP2D6 *1/*2 allele call [Ref: Marez D, Legrand M, Sabbagh N, Guidice J M, Spire C, Lafitte J J, Meyer U A, Broly F. Polymorphism of the cytochrome P450 CYP2D6 gene in a European population: characterization of 48 mutations and 53 alleles, their frequencies and evolution. Pharmacogenetics 1997 June; 7(3):193-202].

In another example, it is useful to know the allele of the gene TPMT, a gene best known for its role in the metabolism of the thiopurine drugs such as azathioprine, 6-mercaptopurine and 6-thioguanine. For example a homozygous mutation in the SNP 719A>G and in the SNP 460G>A, but not in the SNP 238G>C will give a TPMT *3A/*3A allele call, whereas an heterozygous mutation in the SNP 238G>C but not in the others will result in a TPMT *1/*2 allele call [Ref: Thiopurine S-methyltransferase pharmacogenetics: variant allele functional and comparative genomics. Salavaggione O E, Wang L, Wiepert M, Yee V C, Weinshilboum R M. Pharmacogenet Genomics. 2005 November; 15(11):801-15].

For the NAT2 gene, a gene thought to be involved in susceptibility to leukemia, a heterozygous mutation in the SNP 857G>A but not in the others will give a NAT2 *4/*7A allele call, whereas an homozygous mutation in the SNPs 341T>C and 481C>T but not in the others will result in a NAT2 *5A/*5A allele call [Ref: Blum, M., Demierre, A., Grant, D. M., Heim, M., and Meyer, U. A. Molecular mechanism of slow acetylation of drugs and carcinogens in humans. Proc. Natl. Acad. Sci. 88:5237-5241, 1991].

5.1 P450 Allele Determination

P450 haplotypes will be reconstructed using software that analyses the combination of different mutations present in the DNA to give an allele call.

The CYP2D6 allele will be determined combining the genotyping results of the following 29 different mutations [1846G/A, 1584C>G, 100C>T, 138insT, 1023C>T, 1707T>del, 1758G>A, 1758G>T, 1973insG, 2539delAACT, 2549A>del, 2613delAGA, 2850C>T, 3183G>A, 3198C>G, 4042G>A, 4125insGTGCCCACT, 883C>G, 1039C>T, 4180G>C, 2988G>A, 1661G>C, 31G>A, 2936A>C, −392A>G, 29753T>C, 6986G>A, 14690G>A, 19386G>A] plus the results of 4 probes to detect gene multiplication and 3 to detect gene deletion.

5.2 TPMT Allele Determination

TPMT allele will be determined combining the genotyping results of the following 3 different mutations [719A>G, 238G>C, 460G>A].

5.3 NAT2 Allele Determination

NAT2 allele will be determined combining the genotyping results of the following 7 different mutations [34]T>C, 481C>T, 803A>G, 282C>T, 590G>A, 857G>A, 191G>A].

EQUIVALENTS

The foregoing written specification is considered to be sufficient to enable one skilled in the art to practice the invention. The present invention is not to be limited in scope by examples provided, since the examples are intended as a single illustration of one aspect of the invention and other functionally equivalent embodiments are within the scope of the invention. Various modifications of the invention in addition to those shown and described herein will become apparent to those skilled in the art from the foregoing description and fall within the scope of the appended claims. The advantages and objects of the invention are not necessarily encompassed by each embodiment of the invention.

SEQUENCE LISTING (1669 sequences)

SEQ ID NO: 1 - DNA, 25 bp, Artificial sequence
  Synthetic sequence: PCR primer suitable for amplifying target DNA regions comprising genetic variations associated with IBD
gcatagtaagcagtagggagtaaca

SEQ ID NO: 2 - DNA, 21 bp, Artificial sequence
  Synthetic sequence: PCR primer suitable for amplifying target DNA regions comprising genetic variations associated with IBD
tgcaatagcaggagttgttga

SEQ ID NO: 3 - DNA, 20 bp, Artificial sequence
  Synthetic sequence: PCR primer suitable for amplifying target DNA regions comprising genetic variations associated with IBD
tgctcccaggctgtttattt

SEQ ID NO: 4 - DNA, 20 bp, Artificial sequence
  Synthetic sequence: PCR primer suitable for amplifying target DNA regions comprising genetic variations associated with IBD
tgttttcagctgcttgatgg

SEQ ID NO: 5 - DNA, 20 bp, Artificial sequence
  Synthetic sequence: PCR primer suitable for amplifying target DNA regions comprising genetic variations associated with IBD
agatcacagcagccttcctg

SEQ ID NO: 6 - DNA, 20 bp, Artificial sequence
  Synthetic sequence: PCR primer suitable for amplifying target DNA regions comprising genetic variations associated with IBD
ggatggagtggaagtgcttg

SEQ ID NO: 7 - DNA, 20 bp, Artificial sequence
  Synthetic sequence: PCR primer suitable for amplifying target DNA regions comprising genetic variations associated with IBD
actgcagagggaggaggact

SEQ ID NO: 8 - DNA, 20 bp, Artificial sequence
  Synthetic sequence: PCR primer suitable for amplifying target DNA regions comprising genetic variations associated with IBD
ccacctcaagctctggtgat

SEQ ID NO: 9 - DNA, 20 bp, Artificial sequence
  Synthetic sequence: PCR primer suitable for amplifying target DNA regions comprising genetic variations associated with IBD
actggctaactcctgcagtc

SEQ ID NO: 10 - DNA, 20 bp, Artificial sequence
  Synthetic sequence: PCR primer suitable for amplifying target DNA regions comprising genetic variations associated with IBD
gaaaaactgaggttcggaga

SEQ ID NO: 11 - DNA, 20 bp, Artificial sequence
  Synthetic sequence: PCR primer suitable for amplifying target DNA regions comprising genetic variations associated with IBD
ctctcaacttggggtcctga

SEQ ID NO: 12 - DNA, 20 bp, Artificial sequence
  Synthetic sequence: PCR primer suitable for amplifying target DNA regions comprising genetic variations associated with IBD
ggcgttttgcaaacatacct

SEQ ID NO: 13 - DNA, 20 bp, Artificial sequence
  Synthetic sequence: PCR primer suitable for amplifying target DNA regions comprising genetic variations associated with IBD
ccagccaaatgcattctctt

SEQ ID NO: 14 - DNA, 20 bp, Artificial sequence
  Synthetic sequence: PCR primer suitable for amplifying target DNA regions comprising genetic variations associated with IBD
cacagggaaggtgaagggta

SEQ ID NO: 15 - DNA, 20 bp, Artificial sequence
  Synthetic sequence: PCR primer suitable for amplifying target DNA regions comprising genetic variations associated with IBD
caactggctccccttacctt

SEQ ID NO: 16 - DNA, 20 bp, Artificial sequence
  Synthetic sequence: PCR primer suitable for amplifying target DNA regions comprising genetic variations associated with IBD
atggaggctggataggaggt

SEQ ID NO: 17 - DNA, 20 bp, Artificial sequence
  Synthetic sequence: PCR primer suitable for amplifying target DNA regions comprising genetic variations associated with IBD
agaggcctccctgagcttac

SEQ ID NO: 18 - DNA, 20 bp, Artificial sequence
  Synthetic sequence: PCR primer suitable for amplifying target DNA regions comprising genetic variations associated with IBD
tctcggagatctcgaagcat

SEQ ID NO: 19 - DNA, 20 bp, Artificial sequence
  Synthetic sequence: PCR primer suitable for amplifying target DNA regions comprising genetic variations associated with IBD
aactgaagcaatgccagtcc

SEQ ID NO: 20 - DNA, 20 bp, Artificial sequence
  Synthetic sequence: PCR primer suitable for amplifying target DNA regions comprising genetic variations associated with IBD
cagagccagcacctcctaga

SEQ ID NO: 21 - DNA, 20 bp, Artificial sequence
  Synthetic sequence: PCR primer suitable for amplifying target DNA regions comprising genetic variations associated with IBD
cttgagcccaggagtttgag

SEQ ID NO: 22 - DNA, 20 bp, Artificial sequence
  Synthetic sequence: PCR primer suitable for amplifying target DNA regions comprising genetic variations associated with IBD
atcagaggctgcaaaccagt

SEQ ID NO: 23 - DNA, 20 bp, Artificial sequence
  Synthetic sequence: PCR primer suitable for amplifying target DNA regions comprising genetic variations associated with IBD
tggaccgcatgactctatca

SEQ ID NO: 24 - DNA, 19 bp, Artificial sequence
  Synthetic sequence: PCR primer suitable for amplifying target DNA regions comprising genetic variations associated with IBD
ggctctggcttcctagcag

SEQ ID NO: 25 - DNA, 20 bp, Artificial sequence
  Synthetic sequence: PCR primer suitable for amplifying target DNA regions comprising genetic variations associated with IBD
ccagccatcatttccactct

SEQ ID NO: 26 - DNA, 20 bp, Artificial sequence
  Synthetic sequence: PCR primer suitable for amplifying target DNA regions comprising genetic variations associated with IBD
cctgcaccctgtaatcctgt

SEQ ID NO: 27 - DNA, 20 bp, Artificial sequence
  Synthetic sequence: PCR primer suitable for amplifying target DNA regions comprising genetic variations associated with IBD
agccaatccactccttcctt

SEQ ID NO: 28 - DNA, 20 bp, Artificial sequence
  Synthetic sequence: PCR primer suitable for amplifying target DNA regions comprising genetic variations associated with IBD
catgccctaacctgtgctct

SEQ ID NO: 29 - DNA, 20 bp, Artificial sequence
  Synthetic sequence: PCR primer suitable for amplifying target DNA regions comprising genetic variations associated with IBD
atagaggccgatttccttgg

SEQ ID NO: 30 - DNA, 23 bp, Artificial sequence
  Synthetic sequence: PCR primer suitable for amplifying target DNA regions comprising genetic variations associated with IBD
ttctggaacagaagattgtcatt

SEQ ID NO: 31 - DNA, 20 bp, Artificial sequence
  Synthetic sequence: PCR primer suitable for amplifying target DNA regions comprising genetic variations associated with IBD
gctccccagaaacaaactga

SEQ ID NO: 32 - DNA, 20 bp, Artificial sequence
  Synthetic sequence: PCR primer suitable for amplifying target DNA regions comprising genetic variations associated with IBD
cacctgcagaagttcccatt

SEQ ID NO: 33 - DNA, 20 bp, Artificial sequence
  Synthetic sequence: PCR primer suitable for amplifying target DNA regions comprising genetic variations associated with IBD
gctccccagaaacaaactga

SEQ ID NO: 34 - DNA, 20 bp, Artificial sequence
  Synthetic sequence: PCR primer suitable for amplifying target DNA regions comprising genetic variations associated with IBD
cacctgcagaagttcccatt

SEQ ID NO: 35 - DNA, 20 bp, Artificial sequence
  Synthetic sequence: PCR primer suitable for amplifying target DNA regions comprising genetic variations associated with IBD
aggaagctggagcaggtgta

SEQ ID NO: 36 - DNA, 20 bp, Artificial sequence
  Synthetic sequence: PCR primer suitable for amplifying target DNA regions comprising genetic variations associated with IBD
ccattctgactggcactcct

SEQ ID NO: 37 - DNA, 20 bp, Artificial sequence
  Synthetic sequence: PCR primer suitable for amplifying target DNA regions comprising genetic variations associated with IBD
tcttctggaacgtggtaggg

SEQ ID NO: 38 - DNA, 20 bp, Artificial sequence
  Synthetic sequence: PCR primer suitable for amplifying target DNA regions comprising genetic variations associated with IBD
ctaagcagggggttccttgt

SEQ ID NO: 39 - DNA, 20 bp, Artificial sequence
  Synthetic sequence: PCR primer suitable for amplifying target DNA regions comprising genetic variations associated with IBD
cggcgcaattactacctctt

SEQ ID NO: 40 - DNA, 20 bp, Artificial sequence
  Synthetic sequence: PCR primer suitable for amplifying target DNA regions comprising genetic variations associated with IBD
cgtgaatgccagatgaacac

SEQ ID NO: 41 - DNA, 20 bp, Artificial sequence
  Synthetic sequence: PCR primer suitable for amplifying target DNA regions comprising genetic variations associated with IBD
ctccttgcttgctttccttg

SEQ ID NO: 42 - DNA, 20 bp, Artificial sequence
  Synthetic sequence: PCR primer suitable for amplifying target DNA regions comprising genetic variations associated with IBD
agtagggatgggatggatgg

SEQ ID NO: 43 - DNA, 20 bp, Artificial sequence
  Synthetic sequence: PCR primer suitable for amplifying target DNA regions comprising genetic variations associated with IBD
caagagtgcccagagagtcc

SEQ ID NO: 44 - DNA, 21 bp, Artificial sequence
  Synthetic sequence: PCR primer suitable for amplifying target DNA regions comprising genetic variations associated with IBD
ttctccctaaggcattttggt

SEQ ID NO: 45 - DNA, 19 bp, Artificial sequence
  Synthetic sequence: PCR primer suitable for amplifying target DNA regions comprising genetic variations associated with IBD
cttacatagggcgcacgac

SEQ ID NO: 46 - DNA, 18 bp, Artificial sequence
  Synthetic sequence: PCR primer suitable for amplifying target DNA regions comprising genetic variations associated with IBD
agtcccgctgccttccta

SEQ ID NO: 47 - DNA, 20 bp, Artificial sequence
  Synthetic sequence: PCR primer suitable for amplifying target DNA regions comprising genetic variations associated with IBD
ctctagagggcctgtgcaat

SEQ ID NO: 48 - DNA, 20 bp, Artificial sequence
  Synthetic sequence: PCR primer suitable for amplifying target DNA regions comprising genetic variations associated with IBD
tcaatgtgggaaactgtcca

SEQ ID NO: 49 - DNA, 20 bp, Artificial sequence
  Synthetic sequence: PCR primer suitable for amplifying target DNA regions comprising genetic variations associated with IBD
caacaaaggtgggaatgctt

SEQ ID NO: 50 - DNA, 20 bp, Artificial sequence
  Synthetic sequence: PCR primer suitable for amplifying target DNA regions comprising genetic variations associated with IBD
tttcaaattggaatgctgga

SEQ ID NO: 51 - DNA, 20 bp, Artificial sequence
  Synthetic sequence: PCR primer suitable for amplifying target DNA regions comprising genetic variations associated with IBD
aggcagagagggaaggagag

SEQ ID NO: 52 - DNA, 20 bp, Artificial sequence
  Synthetic sequence: PCR primer suitable for amplifying target DNA regions comprising genetic variations associated with IBD
aaacagcgagggagaaactg

SEQ ID NO: 53 - DNA, 20 bp, Artificial sequence
  Synthetic sequence: PCR primer suitable for amplifying target DNA regions comprising genetic variations associated with IBD
ggctgtgctttctcgtcttc

SEQ ID NO: 54 - DNA, 20 bp, Artificial sequence
  Synthetic sequence: PCR primer suitable for amplifying target DNA regions comprising genetic variations associated with IBD
ggtgacgttcaggttgttca

SEQ ID NO: 55 - DNA, 20 bp, Artificial sequence
  Synthetic sequence: PCR primer suitable for amplifying target DNA regions comprising genetic variations associated with IBD
agcaaacccctattccatgc

SEQ ID NO: 56 - DNA, 20 bp, Artificial sequence
  Synthetic sequence: PCR primer suitable for amplifying target DNA regions comprising genetic variations associated with IBD
tacataaatgcccccacgtc

SEQ ID NO: 57 - DNA, 20 bp, Artificial sequence
  Synthetic sequence: PCR primer suitable for amplifying target DNA regions comprising genetic variations associated with IBD
cttgagggcacctacctctg

SEQ ID NO: 58 - DNA, 20 bp, Artificial sequence
  Synthetic sequence: PCR primer suitable for amplifying target DNA regions comprising genetic variations associated with IBD
cattatgactgcggctgcta

SEQ ID NO: 59 - DNA, 20 bp, Artificial sequence
  Synthetic sequence: PCR primer suitable for amplifying target DNA regions comprising genetic variations associated with IBD
gaatgaaatgccccagagaa

SEQ ID NO: 60 - DNA, 20 bp, Artificial sequence
  Synthetic sequence: PCR primer suitable for amplifying target DNA regions comprising genetic variations associated with IBD
actgtggggttcaacctctg

SEQ ID NO: 61 - DNA, 20 bp, Artificial sequence
  Synthetic sequence: PCR primer suitable for amplifying target DNA regions comprising genetic variations associated with IBD
catacagcaccttcgggtct

SEQ ID NO: 62 - DNA, 20 bp, Artificial sequence
  Synthetic sequence: PCR primer suitable for amplifying target DNA regions comprising genetic variations associated with IBD
gggcagactttggaactcag

SEQ ID NO: 63 - DNA, 20 bp, Artificial sequence
  Synthetic sequence: PCR primer suitable for amplifying target DNA regions comprising genetic variations associated with IBD
cataatcaggggttgcatga

SEQ ID NO: 64 - DNA, 20 bp, Artificial sequence
  Synthetic sequence: PCR primer suitable for amplifying target DNA regions comprising genetic variations associated with IBD
ccagagacactgggacatca

SEQ ID NO: 65 - DNA, 20 bp, Artificial sequence
  Synthetic sequence: PCR primer suitable for amplifying target DNA regions comprising genetic variations associated with IBD
ccaaggccatggtgtatagc

SEQ ID NO: 66 - DNA, 20 bp, Artificial sequence
  Synthetic sequence: PCR primer suitable for amplifying target DNA regions comprising genetic variations associated with IBD
gtgccacctcccatctctaa

SEQ ID NO: 67 - DNA, 20 bp, Artificial sequence
  Synthetic sequence: PCR primer suitable for amplifying target DNA regions comprising genetic variations associated with IBD
ctgtttgagggcatcgactt

SEQ ID NO: 68 - DNA, 20 bp, Artificial sequence
  Synthetic sequence: PCR primer suitable for amplifying target DNA regions comprising genetic variations associated with IBD
ggggttgatgctcttgttca

SEQ ID NO: 69 - DNA, 20 bp, Artificial sequence
  Synthetic sequence: PCR primer suitable for amplifying target DNA regions comprising genetic variations associated with IBD
agtcaaagccacagtccaca

SEQ ID NO: 70 - DNA, 20 bp, Artificial sequence
  Synthetic sequence: PCR primer suitable for amplifying target DNA regions comprising genetic variations associated with IBD
ccctgttgagagggtgacat

SEQ ID NO: 71 - DNA, 20 bp, Artificial sequence
  Synthetic sequence: PCR primer suitable for amplifying target DNA regions comprising genetic variations associated with IBD
gcctctcctgactgtcatcc

SEQ ID NO: 72 - DNA, 20 bp, Artificial sequence
  Synthetic sequence: PCR primer suitable for amplifying target DNA regions comprising genetic variations associated with IBD
tcacaaagcggaagaatgtg

SEQ ID NO: 73 - DNA, 20 bp, Artificial sequence
  Synthetic sequence: PCR primer suitable for amplifying target DNA regions comprising genetic variations associated with IBD
acccaaactaggcctcacct

SEQ ID NO: 74 - DNA, 20 bp, Artificial sequence
  Synthetic sequence: PCR primer suitable for amplifying target DNA regions comprising genetic variations associated with IBD
acaggtggcatcttggaaac

SEQ ID NO: 75 - DNA, 20 bp, Artificial sequence
  Synthetic sequence: PCR primer suitable for amplifying target DNA regions comprising genetic variations associated with IBD
tcattttccctcggtttcag

SEQ ID NO: 76 - DNA, 20 bp, Artificial sequence
  Synthetic sequence: PCR primer suitable for amplifying target DNA regions comprising genetic variations associated with IBD
agaacagagggggaagcagt

SEQ ID NO: 77 - DNA, 20 bp, Artificial sequence
  Synthetic sequence: PCR primer suitable for amplifying target DNA regions comprising genetic variations associated with IBD
tggcagcgtcttactcagaa

SEQ ID NO: 78 - DNA, 20 bp, Artificial sequence
  Synthetic sequence: PCR primer suitable for amplifying target DNA regions comprising genetic variations associated with IBD
agaacagcccaacacgtacc

SEQ ID NO: 79 - DNA, 18 bp, Artificial sequence
  Synthetic sequence: PCR primer suitable for amplifying target DNA regions comprising genetic variations associated with IBD
gttccccttgcacgttcc

SEQ ID NO: 80 - DNA, 23 bp, Artificial sequence
  Synthetic sequence: PCR primer suitable for amplifying target DNA regions comprising genetic variations associated with IBD
ttgttggaagaaaagaattgtcc

SEQ ID NO: 81 - DNA, 20 bp, Artificial sequence
  Synthetic sequence: PCR primer suitable for amplifying target DNA regions comprising genetic variations associated with IBD
caacctcagccagacaaggt

SEQ ID NO: 82 - DNA, 20 bp, Artificial sequence
  Synthetic sequence: PCR primer suitable for amplifying target DNA regions comprising genetic variations associated with IBD
cagccacgtgattgtctagg

SEQ ID NO: 83 - DNA, 20 bp, Artificial sequence
  Synthetic sequence: PCR primer suitable for amplifying target DNA regions comprising genetic variations associated with IBD
gcttctggcatctgtccttc

SEQ ID NO: 84 - DNA, 20 bp, Artificial sequence
  Synthetic sequence: PCR primer suitable for amplifying target DNA regions comprising genetic variations associated with IBD
ccggcttaccttctgctgta

SEQ ID NO: 85 - DNA, 20 bp, Artificial sequence
  Synthetic sequence: PCR primer suitable for amplifying target DNA regions comprising genetic variations associated with IBD
acctggtccccaaaagaaat

SEQ ID NO: 86 - DNA, 20 bp, Artificial sequence
  Synthetic sequence: PCR primer suitable for amplifying target DNA regions comprising genetic variations associated with IBD
aaagttggggacacacaagc

SEQ ID NO: 87 - DNA, 20 bp, Artificial sequence
  Synthetic sequence: PCR primer suitable for amplifying target DNA regions comprising genetic variations associated with IBD
accacagcaatgggtaggag

SEQ ID NO: 88 - DNA, 20 bp, Artificial sequence
  Synthetic sequence: PCR primer suitable for amplifying target DNA regions comprising genetic variations associated with IBD
tggtttcagtcttggcttcc

SEQ ID NO: 89 - DNA, 20 bp, Artificial sequence
  Synthetic sequence: PCR primer suitable for amplifying target DNA regions comprising genetic variations associated with IBD
acctggtccccaaaagaaat

SEQ ID NO: 90 - DNA, 20 bp, Artificial sequence
  Synthetic sequence: PCR primer suitable for amplifying target DNA regions comprising genetic variations associated with IBD
aaagttggggacacacaagc

SEQ ID NO: 91 - DNA, 22 bp, Artificial sequence
  Synthetic sequence: PCR primer suitable for amplifying target DNA regions comprising genetic variations associated with IBD
aaaacttttgtggggatatgga

SEQ ID NO: 92 - DNA, 25 bp, Artificial sequence
  Synthetic sequence: PCR primer suitable for amplifying target DNA regions comprising genetic variations associated with IBD
ccctctatttagtcatttgaaaaca

SEQ ID NO: 93 - DNA, 20 bp, Artificial sequence
  Synthetic sequence: PCR primer suitable for amplifying target DNA regions comprising genetic variations associated with IBD
ccaggtccacacattcctct

SEQ ID NO: 94 - DNA, 20 bp, Artificial sequence
  Synthetic sequence: PCR primer suitable for amplifying target DNA regions comprising genetic variations associated with IBD
ttaccatttgcgatcacctg

SEQ ID NO: 95 - DNA, 23 bp, Artificial sequence
  Synthetic sequence: PCR primer suitable for amplifying target DNA regions comprising genetic variations associated with IBD
catccattacattttcaggcttt

SEQ ID NO: 96 - DNA, 21 bp, Artificial sequence
  Synthetic sequence: PCR primer suitable for amplifying target DNA regions comprising genetic variations associated with IBD
ggttgatgcttttgaagaacg

SEQ ID NO: 97 - DNA, 20 bp, Artificial sequence
  Synthetic sequence: PCR primer suitable for amplifying target DNA regions comprising genetic variations associated with IBD
gagccccacagtcttcgtta

SEQ ID NO: 98 - DNA, 20 bp, Artificial sequence
  Synthetic sequence: PCR primer suitable for amplifying target DNA regions comprising genetic variations associated with IBD
tttccgttccctgtcaagtc

SEQ ID NO: 99 - DNA, 20 bp, Artificial sequence
  Synthetic sequence: PCR primer suitable for amplifying target DNA regions comprising genetic variations associated with IBD
gctcttcctctcccaaaacc

SEQ ID NO: 100 - DNA, 20 bp, Artificial sequence
  Synthetic sequence: PCR primer suitable for amplifying target DNA regions comprising genetic variations associated with IBD
caccatggggggcactgttc

SEQ ID NO: 101 - DNA, 20 bp, Artificial sequence
  Synthetic sequence: PCR primer suitable for amplifying target DNA regions comprising genetic variations associated with IBD
aacgaggggtcttggaactc

SEQ ID NO: 102 - DNA, 20 bp, Artificial sequence
  Synthetic sequence: PCR primer suitable for amplifying target DNA regions comprising genetic variations associated with IBD
gtgttctgtgcctcccaagt

SEQ ID NO: 103 - DNA, 20 bp, Artificial sequence
  Synthetic sequence: PCR primer suitable for amplifying target DNA regions comprising genetic variations associated with IBD
cacccaccagagaaggctta

SEQ ID NO: 104 - DNA, 20 bp, Artificial sequence
  Synthetic sequence: PCR primer suitable for amplifying target DNA regions comprising genetic variations associated with IBD
atcacctccccacctctctt

SEQ ID NO: 105 - DNA, 21 bp, Artificial sequence
  Synthetic sequence: PCR primer suitable for amplifying target DNA regions comprising genetic variations associated with IBD
ccaaaagccacactcaaagac

SEQ ID NO: 106 - DNA, 21 bp, Artificial sequence
  Synthetic sequence: PCR primer suitable for amplifying target DNA regions comprising genetic variations associated with IBD
cttgagtgatggtgatgttca

SEQ ID NO: 107 - DNA, 20 bp, Artificial sequence
  Synthetic sequence: PCR primer suitable for amplifying target DNA regions comprising genetic variations associated with IBD
tcaccagggctggattaaag

SEQ ID NO: 108 - DNA, 20 bp, Artificial sequence
  Synthetic sequence: PCR primer suitable for amplifying target DNA regions comprising genetic variations associated with IBD
gcctctggcaacagtaaagc

SEQ ID NO: 109 - DNA, 20 bp, Artificial sequence
  Synthetic sequence: PCR primer suitable for amplifying target DNA regions comprising genetic variations associated with IBD
ctgccgagacgggtatacag

SEQ ID NO: 110 - DNA, 20 bp, Artificial sequence
  Synthetic sequence: PCR primer suitable for amplifying target DNA regions comprising genetic variations associated with IBD
gcaaatgtctcctgggaatg

SEQ ID NO: 111 - DNA, 20 bp, Artificial sequence
  Synthetic sequence: PCR primer suitable for amplifying target DNA regions comprising genetic variations associated with IBD
tgagtccttctcagcctggt

SEQ ID NO: 112 - DNA, 20 bp, Artificial sequence
  Synthetic sequence: PCR primer suitable for amplifying target DNA regions comprising genetic variations associated with IBD
ctctcacgcagctcttcctc

SEQ ID NO: 113 - DNA, 20 bp, Artificial sequence
  Synthetic sequence: PCR primer suitable for amplifying target DNA regions comprising genetic variations associated with IBD
ttctgggccaagttcctcta

SEQ ID NO: 114 - DNA, 19 bp, Artificial sequence
  Synthetic sequence: PCR primer suitable for amplifying target DNA regions comprising genetic variations associated with IBD
ggggcaggtcacagagagt

SEQ ID NO: 115 - DNA, 19 bp, Artificial sequence
  Synthetic sequence: PCR primer suitable for amplifying target DNA regions comprising genetic variations associated with IBD
ctggaaagtttgccaacca

SEQ ID NO: 116 - DNA, 20 bp, Artificial sequence
  Synthetic sequence: PCR primer suitable for amplifying target DNA regions comprising genetic variations associated with IBD
acccaaagtctgggctcttt

SEQ ID NO: 117 - DNA, 19 bp, Artificial sequence
  Synthetic sequence: PCR primer suitable for amplifying target DNA regions comprising genetic variations associated with IBD
gtttaagggcatgtgctac

SEQ ID NO: 118 - DNA, 20 bp, Artificial sequence
  Synthetic sequence: PCR primer suitable for amplifying target DNA regions comprising genetic variations associated with IBD
agctccaactggtagttgtg

SEQ ID NO: 119 - DNA, 21 bp, Artificial sequence
  Synthetic sequence: PCR primer suitable for amplifying target DNA regions comprising genetic variations associated with IBD
gcgcttcgacagcgacgtggg

SEQ ID NO: 120 - DNA, 20 bp, Artificial sequence
  Synthetic sequence: PCR primer suitable for amplifying target DNA regions comprising genetic variations associated with IBD
ctcgccgctgcactgtgaag

SEQ ID NO: 121 - DNA, 20 bp, Artificial sequence
  Synthetic sequence: PCR primer suitable for amplifying target DNA regions comprising genetic variations associated with IBD
acaagttctgggggacacag

SEQ ID NO: 122 - DNA, 20 bp, Artificial sequence
  Synthetic sequence: PCR primer suitable for amplifying target DNA regions comprising genetic variations associated with IBD
attgcacctagggtttgtgc

SEQ ID NO: 123 - DNA, 20 bp, Artificial sequence
  Synthetic sequence: PCR primer suitable for amplifying target DNA regions comprising genetic variations associated with IBD
tgttcttagccaccccactc

SEQ ID NO: 124 - DNA, 20 bp, Artificial sequence
  Synthetic sequence: PCR primer suitable for amplifying target DNA regions comprising genetic variations associated with IBD
gtgatcgtacaggtgcatcg

SEQ ID NO: 125 - DNA, 20 bp, Artificial sequence
  Synthetic sequence: PCR primer suitable for amplifying target DNA regions comprising genetic variations associated with adverse reactions to pharmaceuticals
gccttcaaccccatcatcta

SEQ ID NO: 126 - DNA, 18 bp, Artificial sequence
  Synthetic sequence: PCR primer suitable for amplifying target DNA regions comprising genetic variations associated with adverse reactions to pharmaceuticals
caggctcgagtcgctgtc

SEQ ID NO: 127 - DNA, 18 bp, Artificial sequence
  Synthetic sequence: PCR primer suitable for amplifying target DNA regions comprising genetic variations associated with adverse reactions to pharmaceuticals
gctcacctgccagactgc

SEQ ID NO: 128 - DNA, 20 bp, Artificial sequence
  Synthetic sequence: PCR primer suitable for amplifying target DNA regions comprising genetic variations associated with adverse reactions to pharmaceuticals
gccaggacgatgagagacat

SEQ ID NO: 129 - DNA, 20 bp, Artificial sequence
  Synthetic sequence: PCR primer suitable for amplifying target DNA regions comprising genetic variations associated with adverse reactions to pharmaceuticals
cgcagtaggagagggcatag

SEQ ID NO: 130 - DNA, 20 bp, Artificial sequence
  Synthetic sequence: PCR primer suitable for amplifying target DNA regions comprising genetic variations associated with adverse reactions to pharmaceuticals
caagccccaaagagtctgat

SEQ ID NO: 131 - DNA, 20 bp, Artificial sequence
  Synthetic sequence: PCR primer suitable for amplifying target DNA regions comprising genetic variations associated with adverse reactions to pharmaceuticals
agcaagatgccaagacaaca

SEQ ID NO: 132 - DNA, 20 bp, Artificial sequence
  Synthetic sequence: PCR primer suitable for amplifying target DNA regions comprising genetic variations associated with adverse reactions to pharmaceuticals
cagtgtgccttccacagttg

SEQ ID NO: 133 - DNA, 20 bp, Artificial sequence
  Synthetic sequence: PCR primer suitable for amplifying target DNA regions comprising genetic variations associated with adverse reactions to pharmaceuticals
aggagagacacgacggtgag

SEQ ID NO: 134 - DNA, 22 bp, Artificial sequence
  Synthetic sequence: PCR primer suitable for amplifying target DNA regions comprising genetic variations associated with adverse reactions to pharmaceuticals
caagttctggcttagacatgga

SEQ ID NO: 135 - DNA, 20 bp, Artificial sequence
  Synthetic sequence: PCR primer suitable for amplifying target DNA regions comprising genetic variations associated with adverse reactions to pharmaceuticals
gggcctactgtggctactca

SEQ ID NO: 136 - DNA, 20 bp, Artificial sequence
  Synthetic sequence: PCR primer suitable for amplifying target DNA regions comprising genetic variations associated with adverse reactions to pharmaceuticals
ccctttttccaggtctgaca

SEQ ID NO: 137 - DNA, 20 bp, Artificial sequence
  Synthetic sequence: PCR primer suitable for amplifying target DNA regions comprising genetic variations associated with adverse reactions to pharmaceuticals
tggtggacatggtgaatgac

SEQ ID NO: 138 - DNA, 20 bp, Artificial sequence
  Synthetic sequence: PCR primer suitable for amplifying target DNA regions comprising genetic variations associated with adverse reactions to pharmaceuticals
gtgcaggttgtgtcttgtcc

SEQ ID NO: 139 - DNA, 20 bp, Artificial sequence
  Synthetic sequence: PCR primer suitable for amplifying target DNA regions comprising genetic variations associated with adverse reactions to pharmaceuticals
ttgctagtgacggtgattcg

SEQ ID NO: 140 - DNA, 20 bp, Artificial sequence
  Synthetic sequence: PCR primer suitable for amplifying target DNA regions comprising genetic variations associated with adverse reactions to pharmaceuticals
gagactgcagcaagggtttc

SEQ ID NO: 141 - DNA, 20 bp, Artificial sequence
  Synthetic sequence: PCR primer suitable for amplifying target DNA regions comprising genetic variations associated with adverse reactions to pharmaceuticals
tgtctcccctgtctcattcc

SEQ ID NO: 142 - DNA, 20 bp, Artificial sequence
  Synthetic sequence: PCR primer suitable for amplifying target DNA regions comprising genetic variations associated with adverse reactions to pharmaceuticals
attgcccagcacaggataag

SEQ ID NO: 143 - DNA, 20 bp, Artificial sequence
  Synthetic sequence: PCR primer suitable for amplifying target DNA regions comprising genetic variations associated with adverse reactions to pharmaceuticals
ctcacccctgatggtgctat

SEQ ID NO: 144 - DNA, 20 bp, Artificial sequence
  Synthetic sequence: PCR primer suitable for amplifying target DNA regions comprising genetic variations associated with adverse reactions to pharmaceuticals
tttggaagtgctcacagcag

SEQ ID NO: 145 - DNA, 21 bp, Artificial sequence
  Synthetic sequence: PCR primer suitable for amplifying target DNA regions comprising genetic variations associated with adverse reactions to pharmaceuticals
gagaacattcctctgcagcac

SEQ ID NO: 146 - DNA, 20 bp, Artificial sequence
  Synthetic sequence: PCR primer suitable for amplifying target DNA regions comprising genetic variations associated with adverse reactions to pharmaceuticals
tgtggctttgctttgtcttg

SEQ ID NO: 147 - DNA, 20 bp, Artificial sequence
  Synthetic sequence: PCR primer suitable for amplifying target DNA regions comprising genetic variations associated with adverse reactions to pharmaceuticals
gagcaatgtctggcttctcc

SEQ ID NO: 148 - DNA, 20 bp, Artificial sequence
  Synthetic sequence: PCR primer suitable for amplifying target DNA regions comprising genetic variations associated with adverse reactions to pharmaceuticals
ccagggagagaacatttgga

SEQ ID NO: 149 - DNA, 20 bp, Artificial sequence
  Synthetic sequence: PCR primer suitable for amplifying target DNA regions comprising genetic variations associated with adverse reactions to pharmaceuticals
aggctgtgacaggatggaag

SEQ ID NO: 150 - DNA, 20 bp, Artificial sequence
  Synthetic sequence: PCR primer suitable for amplifying target DNA regions comprising genetic variations associated with adverse reactions to pharmaceuticals
ggtggtcaccaggtatgtcc

SEQ ID NO: 151 - DNA, 20 bp, Artificial sequence
  Synthetic sequence: PCR primer suitable for amplifying target DNA regions comprising genetic variations associated with adverse reactions to pharmaceuticals
cctgggatctccctcctagt

SEQ ID NO: 152 - DNA, 20 bp, Artificial sequence
  Synthetic sequence: PCR primer suitable for amplifying target DNA regions comprising genetic variations associated with adverse reactions to pharmaceuticals
ccacccttggtttttctcaa

SEQ ID NO: 153 - DNA, 20 bp, Artificial sequence
  Synthetic sequence: PCR primer suitable for amplifying target DNA regions comprising genetic variations associated with adverse reactions to pharmaceuticals
ccacatgccctacacagatg

SEQ ID NO: 154 - DNA, 20 bp, Artificial sequence
  Synthetic sequence: PCR primer suitable for amplifying target DNA regions comprising genetic variations associated with adverse reactions to pharmaceuticals
tcgaaaacatggagttgcag

SEQ ID NO: 155 - DNA, 21 bp, Artificial sequence
  Synthetic sequence: PCR primer suitable for amplifying target DNA regions comprising genetic variations associated with adverse reactions to pharmaceuticals
ccgggaactcacaacaaatta

SEQ ID NO: 156 - DNA, 22 bp, Artificial sequence
  Synthetic sequence: PCR primer suitable for amplifying target DNA regions comprising genetic variations associated with adverse reactions to pharmaceuticals
cacaaattcacaagcagtcaca

SEQ ID NO: 157 - DNA, 20 bp, Artificial sequence
  Synthetic sequence: PCR primer suitable for amplifying target DNA regions comprising genetic variations associated with adverse reactions to pharmaceuticals
caggtatggggctagaagca

SEQ ID NO: 158 - DNA, 20 bp, Artificial sequence
  Synthetic sequence: PCR primer suitable for amplifying target DNA regions comprising genetic variations associated with adverse reactions to pharmaceuticals
acctggtcgaagcagtatgg

SEQ ID NO: 159 - DNA, 20 bp, Artificial sequence
  Synthetic sequence: PCR primer suitable for amplifying target DNA regions comprising genetic variations associated with adverse reactions to pharmaceuticals
gatcctggcttgacaagagg

SEQ ID NO: 160 - DNA, 20 bp, Artificial sequence
  Synthetic sequence: PCR primer suitable for amplifying target DNA regions comprising genetic variations associated with adverse reactions to pharmaceuticals
tcccacggaaatctgtctct

SEQ ID NO: 161 - DNA, 19 bp, Artificial sequence
  Synthetic sequence: PCR primer suitable for amplifying target DNA regions comprising genetic variations associated with adverse reactions to pharmaceuticals
gtggggctaatgccttcat

SEQ ID NO: 162 - DNA, 18 bp, Artificial sequence
  Synthetic sequence: PCR primer suitable for amplifying target DNA regions comprising genetic variations associated with adverse reactions to pharmaceuticals
cttcccagttcccgcttt

SEQ ID NO: 163 - DNA, 18 bp, Artificial sequence
  Synthetic sequence: PCR primer suitable for amplifying target DNA regions comprising genetic variations associated with adverse reactions to pharmaceuticals
gtgggtgatgggcagaag

SEQ ID NO: 164 - DNA, 20 bp, Artificial sequence
  Synthetic sequence: PCR primer suitable for amplifying target DNA regions comprising genetic variations associated with adverse reactions to pharmaceuticals
gagggtcgtcgtactcgaag

SEQ ID NO: 165 - DNA, 18 bp, Artificial sequence
  Synthetic sequence: PCR primer suitable for amplifying target DNA regions comprising genetic variations associated with adverse reactions to pharmaceuticals
agccgtgagcaacgtgat

SEQ ID NO: 166 - DNA, 20 bp, Artificial sequence
  Synthetic sequence: PCR primer suitable for amplifying target DNA regions comprising genetic variations associated with adverse reactions to pharmaceuticals
ctgcagagactcctcggtct

SEQ ID NO: 167 - DNA, 20 bp, Artificial sequence
  Synthetic sequence: PCR primer suitable for amplifying target DNA regions comprising genetic variations associated with adverse reactions to pharmaceuticals
caaggtcctacgcttccaaa

SEQ ID NO: 168 - DNA, 20 bp, Artificial sequence
  Synthetic sequence: PCR primer suitable for amplifying target DNA regions comprising genetic variations associated with adverse reactions to pharmaceuticals
gatgcactggtccaaccttt

SEQ ID NO: 169 - DNA, 19 bp, Artificial sequence
  Synthetic sequence: PCR primer suitable for amplifying target DNA regions comprising genetic variations associated with adverse reactions to pharmaceuticals
ggaaccctgagagcagctt

SEQ ID NO: 170 - DNA, 20 bp, Artificial sequence
  Synthetic sequence: PCR primer suitable for amplifying target DNA regions comprising genetic variations associated with adverse reactions to pharmaceuticals
ggtgtcccagcaaagttcat

SEQ ID NO: 171 - DNA, 20 bp, Artificial sequence
  Synthetic sequence: PCR primer suitable for amplifying target DNA regions comprising genetic variations associated with adverse reactions to pharmaceuticals
ggaggcaagaaggagtgtca

SEQ ID NO: 172 - DNA, 20 bp, Artificial sequence
  Synthetic sequence: PCR primer suitable for amplifying target DNA regions comprising genetic variations associated with adverse reactions to pharmaceuticals
cgatgtcacgggatgtcata

SEQ ID NO: 173 - DNA, 20 bp, Artificial sequence
  Synthetic sequence: PCR primer suitable for amplifying target DNA regions comprising genetic variations associated with adverse reactions to pharmaceuticals
ggagtcttgcaggggtatca

SEQ ID NO: 174 - DNA, 20 bp, Artificial sequence
  Synthetic sequence: PCR primer suitable for amplifying target DNA regions comprising genetic variations associated with adverse reactions to pharmaceuticals
tcaccaggaaagcaaagaca

SEQ ID NO: 175 - DNA, 20 bp, Artificial sequence
  Synthetic sequence: PCR primer suitable for amplifying target DNA regions comprising genetic variations associated with adverse reactions to pharmaceuticals
gaacaccaagcatcactgga

SEQ ID NO: 176 - DNA, 21 bp, Artificial sequence
  Synthetic sequence: PCR primer suitable for amplifying target DNA regions comprising genetic variations associated with adverse reactions to pharmaceuticals
gatgtttagtgcaggcccata

SEQ ID NO: 177 - DNA, 20 bp, Artificial sequence
  Synthetic sequence: PCR primer suitable for amplifying target DNA regions comprising genetic variations associated with adverse reactions to pharmaceuticals
ctcacaaccttgcggaattt

SEQ ID NO: 178 - DNA, 20 bp, Artificial sequence
  Synthetic sequence: PCR primer suitable for amplifying target DNA regions comprising genetic variations associated with adverse reactions to pharmaceuticals
cttcaaatctccctccacca

SEQ ID NO: 179 - DNA, 20 bp, Artificial sequence
  Synthetic sequence: PCR primer suitable for amplifying target DNA regions comprising genetic variations associated with adverse reactions to pharmaceuticals
acctgctgagaaaggcatga

SEQ ID NO: 180 - DNA, 20 bp, Artificial sequence
  Synthetic sequence: PCR primer suitable for amplifying target DNA regions comprising genetic variations associated with adverse reactions to pharmaceuticals
ttccagggcacaaccataat

SEQ ID NO: 181 - DNA, 20 bp, Artificial sequence
  Synthetic sequence: PCR primer suitable for amplifying target DNA regions comprising genetic variations associated with adverse reactions to pharmaceuticals
ccatggagttgggcttagag

SEQ ID NO: 182 - DNA, 20 bp, Artificial sequence
  Synthetic sequence: PCR primer suitable for amplifying target DNA regions comprising genetic variations associated with adverse reactions to pharmaceuticals
ccatgccagtgctgtatttg

SEQ ID NO: 183 - DNA, 20 bp, Artificial sequence
  Synthetic sequence: PCR primer suitable for amplifying target DNA regions comprising genetic variations associated with adverse reactions to pharmaceuticals
tggtgtctccaggtcaatca

SEQ ID NO: 184 - DNA, 20 bp, Artificial sequence
  Synthetic sequence: PCR primer suitable for amplifying target DNA regions comprising genetic variations associated with adverse reactions to pharmaceuticals
ggctgatccttcccagaaat

SEQ ID NO: 185 - DNA, 20 bp, Artificial sequence
  Synthetic sequence: PCR primer suitable for amplifying target DNA regions comprising genetic variations associated with adverse reactions to pharmaceuticals
tgacggcaggaattacattg

SEQ ID NO: 186 - DNA, 21 bp, Artificial sequence
  Synthetic sequence: PCR primer suitable for amplifying target DNA regions comprising genetic variations associated with adverse reactions to pharmaceuticals
tgtttcttctttggcaggaga

SEQ ID NO: 187 - DNA, 20 bp, Artificial sequence
  Synthetic sequence: PCR primer suitable for amplifying target DNA regions comprising genetic variations associated with adverse reactions to pharmaceuticals
actgtttggtgggcttcatc

SEQ ID NO: 188 - DNA, 19 bp, Artificial sequence
  Synthetic sequence: PCR primer suitable for amplifying target DNA regions comprising genetic variations associated with adverse reactions to pharmaceuticals
aggtttgggcacgagattt

SEQ ID NO: 189 - DNA, 20 bp, Artificial sequence
  Synthetic sequence: PCR primer suitable for amplifying target DNA regions comprising genetic variations associated with adverse reactions to pharmaceuticals
cctgccaaagaagaaacacc

SEQ ID NO: 190 - DNA, 20 bp, Artificial sequence
  Synthetic sequence: PCR primer suitable for amplifying target DNA regions comprising genetic variations associated with adverse reactions to pharmaceuticals
gatgaagcccaccaaacagt

SEQ ID NO: 191 - DNA, 20 bp, Artificial sequence
  Synthetic sequence: PCR primer suitable for amplifying target DNA regions comprising genetic variations associated with adverse reactions to pharmaceuticals
actgtttggtgggcttcatc

SEQ ID NO: 192 - DNA, 23 bp, Artificial sequence
  Synthetic sequence: PCR primer suitable for amplifying target DNA regions comprising genetic variations associated with adverse reactions to pharmaceuticals
gggtgatacatacacaagggttt

SEQ ID NO: 193 - DNA, 20 bp, Artificial sequence
  Synthetic sequence: PCR primer suitable for amplifying target DNA regions comprising genetic variations associated with adverse reactions to pharmaceuticals
accctgtgatcccactttca

SEQ ID NO: 194 - DNA, 20 bp, Artificial sequence
  Synthetic sequence: PCR primer suitable for amplifying target DNA regions comprising genetic variations associated with adverse reactions to pharmaceuticals
tgtacttcagggcttggtca

SEQ ID NO: 195 - DNA, 21 bp, Artificial sequence
  Synthetic sequence: PCR primer suitable for amplifying target DNA regions comprising genetic variations associated with adverse reactions to pharmaceuticals
caaccagagcttggcatattg

SEQ ID NO: 196 - DNA, 20 bp, Artificial sequence
  Synthetic sequence: PCR primer suitable for amplifying target DNA regions comprising genetic variations associated with adverse reactions to pharmaceuticals
taaagtcccgagggttgttg

SEQ ID NO: 197 - DNA, 20 bp, Artificial sequence
  Synthetic sequence: PCR primer suitable for amplifying target DNA regions comprising genetic variations associated with adverse reactions to pharmaceuticals
tagtgggcctaggtgattgg

SEQ ID NO: 198 - DNA, 20 bp, Artificial sequence
  Synthetic sequence: PCR primer suitable for amplifying target DNA regions comprising genetic variations associated with adverse reactions to pharmaceuticals
tttccaatcactgggagagg

SEQ ID NO: 199 - DNA, 20 bp, Artificial sequence
  Synthetic sequence: PCR primer suitable for amplifying target DNA regions comprising genetic variations associated with adverse reactions to pharmaceuticals
caaccctcgggactttattg

SEQ ID NO: 200 - DNA, 23 bp, Artificial sequence
  Synthetic sequence: PCR primer suitable for amplifying target DNA regions comprising genetic variations associated with adverse reactions to pharmaceuticals
caagcattactccttgacctgtt

SEQ ID NO: 201 - DNA, 20 bp, Artificial sequence
  Synthetic sequence: PCR primer suitable for amplifying target DNA regions comprising genetic variations associated with adverse reactions to pharmaceuticals
cccagtgtcagcttcctctt

SEQ ID NO: 202 - DNA, 20 bp, Artificial sequence
  Synthetic sequence: PCR primer suitable for amplifying target DNA regions comprising genetic variations associated with adverse reactions to pharmaceuticals
gtcctcaatgctcctcttcc

SEQ ID NO: 203 - DNA, 21 bp, Artificial sequence
  Synthetic sequence: PCR primer suitable for amplifying target DNA regions comprising genetic variations associated with adverse reactions to pharmaceuticals
gaatcgttttcagcaatggaa

SEQ ID NO: 204 - DNA, 20 bp, Artificial sequence
  Synthetic sequence: PCR primer suitable for amplifying target DNA regions comprising genetic variations associated with adverse reactions to pharmaceuticals
gtatgttcacccacccttgg

SEQ ID NO: 205 - DNA, 20 bp, Artificial sequence
  Synthetic sequence: PCR primer suitable for amplifying target DNA regions comprising genetic variations associated with adverse reactions to pharmaceuticals
tcaccgaacagttcttgcat

SEQ ID NO: 206 - DNA, 20 bp, Artificial sequence
  Synthetic sequence: PCR primer suitable for amplifying target DNA regions comprising genetic variations associated with adverse reactions to pharmaceuticals
gtcaaggtcctttgggtcaa

SEQ ID NO: 207 - DNA, 20 bp, Artificial sequence
  Synthetic sequence: PCR primer suitable for amplifying target DNA regions comprising genetic variations associated with adverse reactions to pharmaceuticals
gcaggatgttggagtgtgtg

SEQ ID NO: 208 - DNA, 21 bp, Artificial sequence
  Synthetic sequence: PCR primer suitable for amplifying target DNA regions comprising genetic variations associated with adverse reactions to pharmaceuticals
gcaattattggtgggagagtg

SEQ ID NO: 209 - DNA, 20 bp, Artificial sequence
  Synthetic sequence: PCR primer suitable for amplifying target DNA regions comprising genetic variations associated with adverse reactions to pharmaceuticals
tgctcccaggctgtttattt

SEQ ID NO: 210 - DNA, 20 bp, Artificial sequence
  Synthetic sequence: PCR primer suitable for amplifying target DNA regions comprising genetic variations associated with adverse reactions to pharmaceuticals
tgttttcagctgcttgatgg

SEQ ID NO: 211 - DNA, 21 bp, Artificial sequence
  Synthetic sequence: PCR primer suitable for amplifying target DNA regions comprising genetic variations associated with adverse reactions to pharmaceuticals
ggttgatgcttttgaagaacg

SEQ ID NO: 212 - DNA, 23 bp, Artificial sequence
  Synthetic sequence: PCR primer suitable for amplifying target DNA regions comprising genetic variations associated with adverse reactions to pharmaceuticals
catccattacattttcaggcttt

SEQ ID NO: 213 - DNA, 22 bp, Artificial sequence
  Synthetic sequence: PCR primer suitable for amplifying target DNA regions comprising genetic variations associated with adverse reactions to pharmaceuticals
aaaacttttgtggggatatgga

SEQ ID NO: 214 - DNA, 27 bp, Artificial sequence
  Synthetic sequence: PCR primer suitable for amplifying target DNA regions comprising genetic variations associated with adverse reactions to pharmaceuticals
aaccctctatttagtcatttgaaaaca

SEQ ID NO: 215 - DNA, 20 bp, Artificial sequence
  Synthetic sequence: PCR primer suitable for amplifying target DNA regions comprising genetic variations associated with adverse reactions to pharmaceuticals
tccctgtggtctcttcatcc

SEQ ID NO: 216 - DNA, 20 bp, Artificial sequence
  Synthetic sequence: PCR primer suitable for amplifying target DNA regions comprising genetic variations associated with adverse reactions to pharmaceuticals
caaagcggaagaatgtgtca

SEQ ID NO: 217 - DNA, 21 bp, Artificial sequence
  Synthetic sequence: PCR primer suitable for amplifying target DNA regions comprising genetic variations associated with adverse reactions to pharmaceuticals
aaagccacagtctctgaccaa

SEQ ID NO: 218 - DNA, 21 bp, Artificial sequence
  Synthetic sequence: PCR primer suitable for amplifying target DNA regions comprising genetic variations associated with adverse reactions to pharmaceuticals
ggtgctggaatccatacattt

SEQ ID NO: 219 - DNA, 22 bp, Artificial sequence
  Synthetic sequence: PCR primer suitable for amplifying target DNA regions comprising genetic variations associated with adverse reactions to pharmaceuticals
gagaaaatggcttttgtattcg

SEQ ID NO: 220 - DNA, 22 bp, Artificial sequence
  Synthetic sequence: PCR primer suitable for amplifying target DNA regions comprising genetic variations associated with adverse reactions to pharmaceuticals
tgatttttccagtccatcatgt

SEQ ID NO: 221 - DNA, 20 bp, Artificial sequence
  Synthetic sequence: PCR primer suitable for amplifying target DNA regions comprising genetic variations associated with adverse reactions to pharmaceuticals
caggggaggaaatggttaca

SEQ ID NO: 222 - DNA, 20 bp, Artificial sequence
  Synthetic sequence: PCR primer suitable for amplifying target DNA regions comprising genetic variations associated with adverse reactions to pharmaceuticals
tggagccattggcataaaat

SEQ ID NO: 223 - DNA, 20 bp, Artificial sequence
  Synthetic sequence: PCR primer suitable for amplifying target DNA regions comprising genetic variations associated with adverse reactions to pharmaceuticals
agagagccagcgttcatgtt

SEQ ID NO: 224 - DNA, 20 bp, Artificial sequence
  Synthetic sequence: PCR primer suitable for amplifying target DNA regions comprising genetic variations associated with adverse reactions to pharmaceuticals
ctgatgcgtgttctgtgctt

SEQ ID NO: 225 - DNA, 19 bp, Artificial sequence
  Synthetic sequence: PCR primer suitable for amplifying target DNA regions comprising genetic variations associated with adverse reactions to pharmaceuticals
gagtgcagtggtgcgatct

SEQ ID NO: 226 - DNA, 20 bp, Artificial sequence
  Synthetic sequence: PCR primer suitable for amplifying target DNA regions comprising genetic variations associated with adverse reactions to pharmaceuticals
tgaggccaggagttcaagac

SEQ ID NO: 227 - DNA, 20 bp, Artificial sequence
  Synthetic sequence: PCR primer suitable for amplifying target DNA regions comprising genetic variations associated with adverse reactions to pharmaceuticals
ggtggaggtaggagcaacac

SEQ ID NO: 228 - DNA, 20 bp, Artificial sequence
  Synthetic sequence: PCR primer suitable for amplifying target DNA regions comprising genetic variations associated with adverse reactions to pharmaceuticals
ctgctgaacctgcacacatt

SEQ ID NO: 229 - DNA, 20 bp, Artificial sequence
  Synthetic sequence: PCR primer suitable for amplifying target DNA regions comprising genetic variations associated with adverse reactions to pharmaceuticals
cctcatcctcctgctacctg

SEQ ID NO: 230 - DNA, 20 bp, Artificial sequence
  Synthetic sequence: PCR primer suitable for amplifying target DNA regions comprising genetic variations associated with adverse reactions to pharmaceuticals
gaggcagtctccacgaactc

SEQ ID NO: 231 - DNA, 19 bp, Artificial sequence
  Synthetic sequence: PCR primer suitable for amplifying target DNA regions comprising genetic variations associated with adverse reactions to pharmaceuticals
gcctacagcatggatgtga

SEQ ID NO: 232 - DNA, 23 bp, Artificial sequence
  Synthetic sequence: PCR primer suitable for amplifying target DNA regions comprising genetic variations associated with adverse reactions to pharmaceuticals
tggaattgtaccttttaagtgga

SEQ ID NO: 233 - DNA, 20 bp, Artificial sequence
  Synthetic sequence: PCR primer suitable for amplifying target DNA regions comprising genetic variations associated with adverse reactions to pharmaceuticals
tcacaatccctgtgacctga

SEQ ID NO: 234 - DNA, 20 bp, Artificial sequence
  Synthetic sequence: PCR primer suitable for amplifying target DNA regions comprising genetic variations associated with adverse reactions to pharmaceuticals
ggggcatttttactgatgga

SEQ ID NO: 235 - DNA, 20 bp, Artificial sequence
  Synthetic sequence: PCR primer suitable for amplifying target DNA regions comprising genetic variations associated with adverse reactions to pharmaceuticals
tgaaaccaccagcagtgttc

SEQ ID NO: 236 - DNA, 20 bp, Artificial sequence
  Synthetic sequence: PCR primer suitable for amplifying target DNA regions comprising genetic variations associated with adverse reactions to pharmaceuticals
aaaattctcctggggagtgg

SEQ ID NO: 237 - DNA, 23 bp, Artificial sequence
  Synthetic sequence: PCR primer suitable for amplifying target DNA regions comprising genetic variations associated with adverse reactions to pharmaceuticals
acccctaacatgtaactctgtgg

SEQ ID NO: 238 - DNA, 23 bp, Artificial sequence
  Synthetic sequence: PCR primer suitable for amplifying target DNA regions comprising genetic variations associated with adverse reactions to pharmaceuticals
tttgaaggagaagttctgaagga

SEQ ID NO: 239 - DNA, 20 bp, Artificial sequence
  Synthetic sequence: PCR primer suitable for amplifying target DNA regions comprising genetic variations associated with adverse reactions to pharmaceuticals
cacccagcttaacgaatgct

SEQ ID NO: 240 - DNA, 20 bp, Artificial sequence
  Synthetic sequence: PCR primer suitable for amplifying target DNA regions comprising genetic variations associated with adverse reactions to pharmaceuticals
ccaggaagccagactttgat

SEQ ID NO: 241 - DNA, 20 bp, Artificial sequence
  Synthetic sequence: PCR primer suitable for amplifying target DNA regions comprising genetic variations associated with adverse reactions to pharmaceuticals
acccctaatgtccctactgc

SEQ ID NO: 242 - DNA, 19 bp, Artificial sequence
  Synthetic sequence: PCR primer suitable for amplifying target DNA regions comprising genetic variations associated with adverse reactions to pharmaceuticals
ggagatcctgggagaggtg

SEQ ID NO: 243 - DNA, 20 bp, Artificial sequence
  Synthetic sequence: PCR primer suitable for amplifying target DNA regions comprising genetic variations associated with adverse reactions to pharmaceuticals
ttctggggaaattctcatgg

SEQ ID NO: 244 - DNA, 20 bp, Artificial sequence
  Synthetic sequence: PCR primer suitable for amplifying target DNA regions comprising genetic variations associated with adverse reactions to pharmaceuticals
tcaggtttgggaactcatcc

SEQ ID NO: 245 - DNA, 20 bp, Artificial sequence
  Synthetic sequence: PCR primer suitable for amplifying target DNA regions comprising genetic variations associated with adverse reactions to pharmaceuticals
atggtttgcaggaaacaagg

SEQ ID NO: 246 - DNA, 20 bp, Artificial sequence
  Synthetic sequence: PCR primer suitable for amplifying target DNA regions comprising genetic variations associated with adverse reactions to pharmaceuticals
aaagcgggagatgaagtcct

SEQ ID NO: 247 - DNA, 20 bp, Artificial sequence
  Synthetic sequence: PCR primer suitable for amplifying target DNA regions comprising genetic variations associated with adverse reactions to pharmaceuticals
ggcagcataagcaggacttc

SEQ ID NO: 248 - DNA, 20 bp, Artificial sequence
  Synthetic sequence: PCR primer suitable for amplifying target DNA regions comprising genetic variations associated with adverse reactions to pharmaceuticals
gttgctcgaggacaagttcc

SEQ ID NO: 249 - DNA, 17 bp, Artificial sequence
  Synthetic sequence: PCR primer suitable for amplifying target DNA regions comprising genetic variations associated with adverse reactions to pharmaceuticals
gcacggctgtccaagga

SEQ ID NO: 250 - DNA, 17 bp, Artificial sequence
  Synthetic sequence: PCR primer suitable for amplifying target DNA regions comprising genetic variations associated with adverse reactions to pharmaceuticals
gcgggccccggcctggt

SEQ ID NO: 251 - DNA, 20 bp, Artificial sequence
  Synthetic sequence: PCR primer suitable for amplifying target DNA regions comprising genetic variations associated with adverse reactions to pharmaceuticals
acctggtccccaaaagaaat

SEQ ID NO: 252 - DNA, 20 bp, Artificial sequence
  Synthetic sequence: PCR primer suitable for amplifying target DNA regions comprising genetic variations associated with adverse reactions to pharmaceuticals
aaagttggggacacacaagc

SEQ ID NO: 253 - DNA, 22 bp, Artificial sequence
  Synthetic sequence: PCR primer suitable for amplifying target DNA regions comprising genetic variations associated with adverse reactions to pharmaceuticals
cacacacacacacaaatccaag

SEQ ID NO: 254 - DNA, 20 bp, Artificial sequence
  Synthetic sequence: PCR primer suitable for amplifying target DNA regions comprising genetic variations associated with adverse reactions to pharmaceuticals
gatggggtggaagaagttga

SEQ ID NO: 255 - DNA, 25 bp, Artificial sequence
  Synthetic sequence: Probe suitable for detection of genetic variations associated with known erythrocyte antigens, and useful for genotyping for blood groups
cagccaaggggtcaccacgaggaca

SEQ ID NO: 256 - DNA, 25 bp, Artificial sequence
  Synthetic sequence: Probe suitable for detection of genetic variations associated with known erythrocyte antigens, and useful for genotyping for blood groups
ccagccaaggggtaccacgaggaca

SEQ ID NO: 257 - DNA, 27 bp, Artificial sequence
  Synthetic sequence: Probe suitable for detection of genetic variations associated with known erythrocyte antigens, and useful for genotyping for blood groups
ccagccaaggggtcaccacgaggacat

SEQ ID NO: 258 - DNA, 27 bp, Artificial sequence
  Synthetic sequence: Probe suitable for detection of genetic variations associated with known erythrocyte antigens, and useful for genotyping for blood groups
gccagccaaggggtaccacgaggacat

SEQ ID NO: 259 - DNA, 25 bp, Artificial sequence
  Synthetic sequence: Probe suitable for detection of genetic variations associated with known erythrocyte antigens, and useful for genotyping for blood groups
accctgcaccccggcttctacggaa

SEQ ID NO: 260 - DNA, 25 bp, Artificial sequence
  Synthetic sequence: Probe suitable for detection of genetic variations associated with known erythrocyte antigens, and useful for genotyping for blood groups
accctgcaccccagcttctacggaa

SEQ ID NO: 261 - DNA, 27 bp, Artificial sequence
  Synthetic sequence: Probe suitable for detection of genetic variations associated with known erythrocyte antigens, and useful for genotyping for blood groups
caccctgcaccccggcttctacggaag

SEQ ID NO: 262 - DNA, 27 bp, Artificial sequence
  Synthetic sequence: Probe suitable for detection of genetic variations associated with known erythrocyte antigens, and useful for genotyping for blood groups
caccctgcaccccagcttctacggaag

SEQ ID NO: 263 - DNA, 25 bp, Artificial sequence
  Synthetic sequence: Probe suitable for detection of genetic variations associated with known erythrocyte antigens, and useful for genotyping for blood groups
agaacccccccaggtagtagaaatc

SEQ ID NO: 264 - DNA, 25 bp, Artificial sequence
  Synthetic sequence: Probe suitable for detection of genetic variations associated with known erythrocyte antigens, and useful for genotyping for blood groups
agaacccccccatgtagtagaaatc

SEQ ID NO: 265 - DNA, 27 bp, Artificial sequence
  Synthetic sequence: Probe suitable for detection of genetic variations associated with known erythrocyte antigens, and useful for genotyping for blood groups
aagaacccccccaggtagtagaaatcg

SEQ ID NO: 266 - DNA, 27 bp, Artificial sequence
  Synthetic sequence: Probe suitable for detection of genetic variations associated with known erythrocyte antigens, and useful for genotyping for blood groups
aagaacccccccatgtagtagaaatcg

SEQ ID NO: 267 - DNA, 25 bp, Artificial sequence
  Synthetic sequence: Probe suitable for detection of genetic variations associated with known erythrocyte antigens, and useful for genotyping for blood groups
ccccgaagaacccccccaggtagta

SEQ ID NO: 268 - DNA, 25 bp, Artificial sequence
  Synthetic sequence: Probe suitable for detection of genetic variations associated with known erythrocyte antigens, and useful for genotyping for blood groups
ccccgaagaacctccccaggtagta

SEQ ID NO: 269 - DNA, 23 bp, Artificial sequence
  Synthetic sequence: Probe suitable for detection of genetic variations associated with known erythrocyte antigens, and useful for genotyping for blood groups
cccgaagaacccccccaggtagt

SEQ ID NO: 270 - DNA, 23 bp, Artificial sequence
  Synthetic sequence: Probe suitable for detection of genetic variations associated with known erythrocyte antigens, and useful for genotyping for blood groups
cccgaagaacctccccaggtagt

SEQ ID NO: 271 - DNA, 25 bp, Artificial sequence
  Synthetic sequence: Probe suitable for detection of genetic variations associated with known erythrocyte antigens, and useful for genotyping for blood groups
cccccgaagaacccccccaggtagt

SEQ ID NO: 272 - DNA, 25 bp, Artificial sequence
  Synthetic sequence: Probe suitable for detection of genetic variations associated with known erythrocyte antigens, and useful for genotyping for blood groups
cccccgaagaacgcccccaggtagt

SEQ ID NO: 273 - DNA, 27 bp, Artificial sequence
  Synthetic sequence: Probe suitable for detection of genetic variations associated with known erythrocyte antigens, and useful for genotyping for blood groups
acccccgaagaacccccccaggtagta

SEQ ID NO: 274 - DNA, 27 bp, Artificial sequence
  Synthetic sequence: Probe suitable for detection of genetic variations associated with known erythrocyte antigens, and useful for genotyping for blood groups
acccccgaagaacgcccccaggtagta

SEQ ID NO: 275 - DNA, 25 bp, Artificial sequence
  Synthetic sequence: Probe suitable for detection of genetic variations associated with known erythrocyte antigens, and useful for genotyping for blood groups
cggtccggaacccgtgagcggctgc

SEQ ID NO: 276 - DNA, 25 bp, Artificial sequence
  Synthetic sequence: Probe suitable for detection of genetic variations associated with known erythrocyte antigens, and useful for genotyping for blood groups
cggtccggaaccgtgagcggctgcc

SEQ ID NO: 277 - DNA, 27 bp, Artificial sequence
  Synthetic sequence: Probe suitable for detection of genetic variations associated with known erythrocyte antigens, and useful for genotyping for blood groups
gcggtccggaacccgtgagcggctgcc

SEQ ID NO: 278 - DNA, 27 bp, Artificial sequence
  Synthetic sequence: Probe suitable for detection of genetic variations associated with known erythrocyte antigens, and useful for genotyping for blood groups
gcggtccggaaccgtgagcggctgcca

SEQ ID NO: 279 - DNA, 19 bp, Artificial sequence
  Synthetic sequence: Probe suitable for detection of genetic variations associated with known erythrocyte antigens, and useful for genotyping for blood groups
ccccgaagaacccccccag

SEQ ID NO: 280 - DNA, 19 bp, Artificial sequence
  Synthetic sequence: Probe suitable for detection of genetic variations associated with known erythrocyte antigens, and useful for genotyping for blood groups
cccgaagaaccccccccag

SEQ ID NO: 281 - DNA, 21 bp, Artificial sequence
  Synthetic sequence: Probe suitable for detection of genetic variations associated with known erythrocyte antigens, and useful for genotyping for blood groups
cccccgaagaacccccccagg

SEQ ID NO: 282 - DNA, 21 bp, Artificial sequence
  Synthetic sequence: Probe suitable for detection of genetic variations associated with known erythrocyte antigens, and useful for genotyping for blood groups
ccccgaagaaccccccccagg

SEQ ID NO: 283 - DNA, 25 bp, Artificial sequence
  Synthetic sequence: Probe suitable for detection of genetic variations associated with known erythrocyte antigens, and useful for genotyping for blood groups
tgcttgtcttggtcttgtttgggta

SEQ ID NO: 284 - DNA, 25 bp, Artificial sequence
  Synthetic sequence: Probe suitable for detection of genetic variations associated with known erythrocyte antigens, and useful for genotyping for blood groups
tgcttgtcttgggtcttgtttgggt

SEQ ID NO: 285 - DNA, 23 bp, Artificial sequence
  Synthetic sequence: Probe suitable for detection of genetic variations associated with known erythrocyte antigens, and useful for genotyping for blood groups
gcttgtcttggtcttgtttgggt

SEQ ID NO: 286 - DNA, 23 bp, Artificial sequence
  Synthetic sequence: Probe suitable for detection of genetic variations associated with known erythrocyte antigens, and useful for genotyping for blood groups
gcttgtcttgggtcttgtttggg

SEQ ID NO: 287 - DNA, 25 bp, Artificial sequence
  Synthetic sequence: Probe suitable for detection of genetic variations associated with known erythrocyte antigens, and useful for genotyping for blood groups
ggagcctgaactgctcgttgaggat

SEQ ID NO: 288 - DNA, 25 bp, Artificial sequence
  Synthetic sequence: Probe suitable for detection of genetic variations associated with known erythrocyte antigens, and useful for genotyping for blood groups
ggagcctgaactactcgttgaggat

SEQ ID NO: 289 - DNA, 27 bp, Artificial sequence
  Synthetic sequence: Probe suitable for detection of genetic variations associated with known erythrocyte antigens, and useful for genotyping for blood groups
tggagcctgaactgctcgttgaggatg

SEQ ID NO: 290 - DNA, 27 bp, Artificial sequence
  Synthetic sequence: Probe suitable for detection of genetic variations associated with known erythrocyte antigens, and useful for genotyping for blood groups
tggagcctgaactactcgttgaggatg

SEQ ID NO: 291 - DNA, 25 bp, Artificial sequence
  Synthetic sequence: Probe suitable for detection of genetic variations associated with known erythrocyte antigens, and useful for genotyping for blood groups
tcgtgccacacggcctcgatgccgt

SEQ ID NO: 292 - DNA, 25 bp, Artificial sequence
  Synthetic sequence: Probe suitable for detection of genetic variations associated with known erythrocyte antigens, and useful for genotyping for blood groups
tcgtgccacacgacctcgatgccgt

SEQ ID NO: 293 - DNA, 23 bp, Artificial sequence
  Synthetic sequence: Probe suitable for detection of genetic variations associated with known erythrocyte antigens, and useful for genotyping for blood groups
cgtgccacacggcctcgatgccg

SEQ ID NO: 294 - DNA, 23 bp, Artificial sequence
  Synthetic sequence: Probe suitable for detection of genetic variations associated with known erythrocyte antigens, and useful for genotyping for blood groups
cgtgccacacgacctcgatgccg

SEQ ID NO: 295 - DNA, 25 bp, Artificial sequence
  Synthetic sequence: Probe suitable for detection of genetic variations associated with known erythrocyte antigens, and useful for genotyping for blood groups
cctgaacaagtacctgctgcgccac

SEQ ID NO: 296 - DNA, 25 bp, Artificial sequence
  Synthetic sequence: Probe suitable for detection of genetic variations associated with known erythrocyte antigens, and useful for genotyping for blood groups
cctgaacaagtaactgctgcgccac

SEQ ID NO: 297 - DNA, 27 bp, Artificial sequence
  Synthetic sequence: Probe suitable for detection of genetic variations associated with known erythrocyte antigens, and useful for genotyping for blood groups
acctgaacaagtacctgctgcgccaca

SEQ ID NO: 298 - DNA, 27 bp, Artificial sequence
  Synthetic sequence: Probe suitable for detection of genetic variations associated with known erythrocyte antigens, and useful for genotyping for blood groups
acctgaacaagtaactgctgcgccaca

SEQ ID NO: 299 - DNA, 25 bp, Artificial sequence
  Synthetic sequence: Probe suitable for detection of genetic variations associated with known erythrocyte antigens, and useful for genotyping for blood groups
accatctgcagcgcgtctcgttgcc

SEQ ID NO: 300 - DNA, 25 bp, Artificial sequence
  Synthetic sequence: Probe suitable for detection of genetic variations associated with known erythrocyte antigens, and useful for genotyping for blood groups
accatctgcagcatgtctcgttgcc

SEQ ID NO: 301 - DNA, 23 bp, Artificial sequence
  Synthetic sequence: Probe suitable for detection of genetic variations associated with known erythrocyte antigens, and useful for genotyping for blood groups
ccatctgcagcgcgtctcgttgc

SEQ ID NO: 302 - DNA, 23 bp, Artificial sequence
  Synthetic sequence: Probe suitable for detection of genetic variations associated with known erythrocyte antigens, and useful for genotyping for blood groups
ccatctgcagcatgtctcgttgc

SEQ ID NO: 303 - DNA, 25 bp, Artificial sequence
  Synthetic sequence: Probe suitable for detection of genetic variations associated with known erythrocyte antigens, and useful for genotyping for blood groups
gacacgtcctgccagcgcttgtagg

SEQ ID NO: 304 - DNA, 25 bp, Artificial sequence
  Synthetic sequence: Probe suitable for detection of genetic variations associated with known erythrocyte antigens, and useful for genotyping for blood groups
gacacgtcctgctagcgcttgtagg

SEQ ID NO: 305 - DNA, 23 bp, Artificial sequence
  Synthetic sequence: Probe suitable for detection of genetic variations associated with known erythrocyte antigens, and useful for genotyping for blood groups
acacgtcctgccagcgcttgtag

SEQ ID NO: 306 - DNA, 23 bp, Artificial sequence
  Synthetic sequence: Probe suitable for detection of genetic variations associated with known erythrocyte antigens, and useful for genotyping for blood groups
acacgtcctgctagcgcttgtag

SEQ ID NO: 307 - DNA, 25 bp, Artificial sequence
  Synthetic sequence: Probe suitable for detection of genetic variations associated with known erythrocyte antigens, and useful for genotyping for blood groups
ggcaccgcggccggctggtcggtga

SEQ ID NO: 308 - DNA, 25 bp, Artificial sequence
  Synthetic sequence: Probe suitable for detection of genetic variations associated with known erythrocyte antigens, and useful for genotyping for blood groups
ggcaccgcggccagctggtcggtga

SEQ ID NO: 309 - DNA, 27 bp, Artificial sequence
  Synthetic sequence: Probe suitable for detection of genetic variations associated with known erythrocyte antigens, and useful for genotyping for blood groups
gggcaccgcggccggctggtcggtgaa

SEQ ID NO: 310 - DNA, 27 bp, Artificial sequence
  Synthetic sequence: Probe suitable for detection of genetic variations associated with known erythrocyte antigens, and useful for genotyping for blood groups
gggcaccgcggccagctggtcggtgaa

SEQ ID NO: 311 - DNA, 25 bp, Artificial sequence
  Synthetic sequence: Probe suitable for detection of genetic variations associated with known erythrocyte antigens, and useful for genotyping for blood groups
gtggacatggagttccgcgaccacg

SEQ ID NO: 312 - DNA, 25 bp, Artificial sequence
  Synthetic sequence: Probe suitable for detection of genetic variations associated with known erythrocyte antigens, and useful for genotyping for blood groups
gtggacatggagatccgcgaccacg

SEQ ID NO: 313 - DNA, 27 bp, Artificial sequence
  Synthetic sequence: Probe suitable for detection of genetic variations associated with known erythrocyte antigens, and useful for genotyping for blood groups
cgtggacatggagttccgcgaccacgt

SEQ ID NO: 314 - DNA, 27 bp, Artificial sequence
  Synthetic sequence: Probe suitable for detection of genetic variations associated with known erythrocyte antigens, and useful for genotyping for blood groups
cgtggacatggagatccgcgaccacgt

SEQ ID NO: 315 - DNA, 25 bp, Artificial sequence
  Synthetic sequence: Probe suitable for detection of genetic variations associated with known erythrocyte antigens, and useful for genotyping for blood groups
gtgatggcggccattggcttgggct

SEQ ID NO: 316 - DNA, 25 bp, Artificial sequence
  Synthetic sequence: Probe suitable for detection of genetic variations associated with known erythrocyte antigens, and useful for genotyping for blood groups
gtgatggcggcccttggcttgggct

SEQ ID NO: 317 - DNA, 23 bp, Artificial sequence
  Synthetic sequence: Probe suitable for detection of genetic variations associated with known erythrocyte antigens, and useful for genotyping for blood groups
tgatggcggccattggcttgggc

SEQ ID NO: 318 - DNA, 23 bp, Artificial sequence
  Synthetic sequence: Probe suitable for detection of genetic variations associated with known erythrocyte antigens, and useful for genotyping for blood groups
tgatggcggcccttggcttgggc

SEQ ID NO: 319 - DNA, 25 bp, Artificial sequence
  Synthetic sequence: Probe suitable for detection of genetic variations associated with known erythrocyte antigens, and useful for genotyping for blood groups
tcctcacctcgagtttccggagaca

SEQ ID NO: 320 - DNA, 25 bp, Artificial sequence
  Synthetic sequence: Probe suitable for detection of genetic variations associated with known erythrocyte antigens, and useful for genotyping for blood groups
tcctcacctcgaatttccggagaca

SEQ ID NO: 321 - DNA, 27 bp, Artificial sequence
  Synthetic sequence: Probe suitable for detection of genetic variations associated with known erythrocyte antigens, and useful for genotyping for blood groups
ttcctcacctcgagtttccggagacac

SEQ ID NO: 322 - DNA, 27 bp, Artificial sequence
  Synthetic sequence: Probe suitable for detection of genetic variations associated with known erythrocyte antigens, and useful for genotyping for blood groups
ttcctcacctcgaatttccggagacac

SEQ ID NO: 323 - DNA, 25 bp, Artificial sequence
  Synthetic sequence: Probe suitable for detection of genetic variations associated with known erythrocyte antigens, and useful for genotyping for blood groups
agccagttcccttctgggaaggtgg

SEQ ID NO: 324 - DNA, 25 bp, Artificial sequence
  Synthetic sequence: Probe suitable for detection of genetic variations associated with known erythrocyte antigens, and useful for genotyping for blood groups
agccagttccctcctgggaaggtgg

SEQ ID NO: 325 - DNA, 27 bp, Artificial sequence
  Synthetic sequence: Probe suitable for detection of genetic variations associated with known erythrocyte antigens, and useful for genotyping for blood groups
gagccagttcccttctgggaaggtggt

SEQ ID NO: 326 - DNA, 27 bp, Artificial sequence
  Synthetic sequence: Probe suitable for detection of genetic variations associated with known erythrocyte antigens, and useful for genotyping for blood groups
gagccagttccctcctgggaaggtggt

SEQ ID NO: 327 - DNA, 25 bp, Artificial sequence
  Synthetic sequence: Probe suitable for detection of genetic variations associated with known erythrocyte antigens, and useful for genotyping for blood groups
tattttgggctgtctgtggcctggt

SEQ ID NO: 328 - DNA, 25 bp, Artificial sequence
  Synthetic sequence: Probe suitable for detection of genetic variations associated with known erythrocyte antigens, and useful for genotyping for blood groups
tattttgggctgactgtggcctggt

SEQ ID NO: 329 - DNA, 21 bp, Artificial sequence
  Synthetic sequence: Probe suitable for detection of genetic variations associated with known erythrocyte antigens, and useful for genotyping for blood groups
ttttgggctgtctgtggcctg

SEQ ID NO: 330 - DNA, 21 bp, Artificial sequence
  Synthetic sequence: Probe suitable for detection of genetic variations associated with known erythrocyte antigens, and useful for genotyping for blood groups
ttttgggctgactgtggcctg

SEQ ID NO: 331 - DNA, 23 bp, Artificial sequence
  Synthetic sequence: Probe suitable for detection of genetic variations associated with known erythrocyte antigens, and useful for genotyping for blood groups
agcctctacccgagggaacggag

SEQ ID NO: 332 - DNA, 23 bp, Artificial sequence
  Synthetic sequence: Probe suitable for detection of genetic variations associated with known erythrocyte antigens, and useful for genotyping for blood groups
agcctctacccaagggaacggag

SEQ ID NO: 333 - DNA, 21 bp, Artificial sequence
  Synthetic sequence: Probe suitable for detection of genetic variations associated with known erythrocyte antigens, and useful for genotyping for blood groups
gcctctacccgagggaacgga

SEQ ID NO: 334 - DNA, 21 bp, Artificial sequence
  Synthetic sequence: Probe suitable for detection of genetic variations associated with known erythrocyte antigens, and useful for genotyping for blood groups
gcctctacccaagggaacgga

SEQ ID NO: 335 - DNA, 23 bp, Artificial sequence
  Synthetic sequence: Probe suitable for detection of genetic variations associated with known erythrocyte antigens, and useful for genotyping for blood groups
acggaggataaagatcagacagc

SEQ ID NO: 336 - DNA, 23 bp, Artificial sequence
  Synthetic sequence: Probe suitable for detection of genetic variations associated with known erythrocyte antigens, and useful for genotyping for blood groups
acggaggataatgatcagacagc

SEQ ID NO: 337 - DNA, 21 bp, Artificial sequence
  Synthetic sequence: Probe suitable for detection of genetic variations associated with known erythrocyte antigens, and useful for genotyping for blood groups
cggaggataaagatcagacag

SEQ ID NO: 338 - DNA, 21 bp, Artificial sequence
  Synthetic sequence: Probe suitable for detection of genetic variations associated with known erythrocyte antigens, and useful for genotyping for blood groups
cggaggataatgatcagacag

SEQ ID NO: 339 - DNA, 25 bp, Artificial sequence
  Synthetic sequence: Probe suitable for detection of genetic variations associated with known erythrocyte antigens, and useful for genotyping for blood groups
agaagtccaatcgaaaggaagaatg

SEQ ID NO: 340 - DNA, 25 bp, Artificial sequence
  Synthetic sequence: Probe suitable for detection of genetic variations associated with known erythrocyte antigens, and useful for genotyping for blood groups
agaagtccaatccaaaggaagaatg

SEQ ID NO: 341 - DNA, 23 bp, Artificial sequence
  Synthetic sequence: Probe suitable for detection of genetic variations associated with known erythrocyte antigens, and useful for genotyping for blood groups
gaagtccaatcgaaaggaagaat

SEQ ID NO: 342 - DNA, 23 bp, Artificial sequence
  Synthetic sequence: Probe suitable for detection of genetic variations associated with known erythrocyte antigens, and useful for genotyping for blood groups
gaagtccaatccaaaggaagaat

SEQ ID NO: 343 - DNA, 23 bp, Artificial sequence
  Synthetic sequence: Probe suitable for detection of genetic variations associated with known erythrocyte antigens, and useful for genotyping for blood groups
ggaagaatgccgtgttcaacacc

SEQ ID NO: 344 - DNA, 23 bp, Artificial sequence
  Synthetic sequence: Probe suitable for detection of genetic variations associated with known erythrocyte antigens, and useful for genotyping for blood groups
ggaagaatgccatgttcaacacc

SEQ ID NO: 345 - DNA, 21 bp, Artificial sequence
  Synthetic sequence: Probe suitable for detection of genetic variations associated with known erythrocyte antigens, and useful for genotyping for blood groups
gaagaatgccgtgttcaacac

SEQ ID NO: 346 - DNA, 21 bp, Artificial sequence
  Synthetic sequence: Probe suitable for detection of genetic variations associated with known erythrocyte antigens, and useful for genotyping for blood groups
gaagaatgccatgttcaacac

SEQ ID NO: 347 - DNA, 23 bp, Artificial sequence
  Synthetic sequence: Probe suitable for detection of genetic variations associated with known erythrocyte antigens, and useful for genotyping for blood groups
tggagagatcatctacattgtgc

SEQ ID NO: 348 - DNA, 23 bp, Artificial sequence
  Synthetic sequence: Probe suitable for detection of genetic variations associated with known erythrocyte antigens, and useful for genotyping for blood groups
tggagagatcacctacattgtgc

SEQ ID NO: 349 - DNA, 21 bp, Artificial sequence
  Synthetic sequence: Probe suitable for detection of genetic variations associated with known erythrocyte antigens, and useful for genotyping for blood groups
ggagagatcatctacattgtg

SEQ ID NO: 350 - DNA, 21 bp, Artificial sequence
  Synthetic sequence: Probe suitable for detection of genetic variations associated with known erythrocyte antigens, and useful for genotyping for blood groups
ggagagatcacctacattgtg

SEQ ID NO: 351 - DNA, 25 bp, Artificial sequence
  Synthetic sequence: Probe suitable for detection of genetic variations associated with known erythrocyte antigens, and useful for genotyping for blood groups
agtttcaactctgctctgctgagaa

SEQ ID NO: 352 - DNA, 25 bp, Artificial sequence
  Synthetic sequence: Probe suitable for detection of genetic variations associated with known erythrocyte antigens, and useful for genotyping for blood groups
agtttcaactctcctctgctgagaa

SEQ ID NO: 353 - DNA, 27 bp, Artificial sequence
  Synthetic sequence: Probe suitable for detection of genetic variations associated with known erythrocyte antigens, and useful for genotyping for blood groups
aattttcaactctgctctgctgagaag

SEQ ID NO: 354 - DNA, 27 bp, Artificial sequence
  Synthetic sequence: Probe suitable for detection of genetic variations associated with known erythrocyte antigens, and useful for genotyping for blood groups
aagtttcaactctcctctgctgagaag

SEQ ID NO: 355 - DNA, 25 bp, Artificial sequence
  Synthetic sequence: Probe suitable for detection of genetic variations associated with known erythrocyte antigens, and useful for genotyping for blood groups
accgtcggagccggcaatggcatgt

SEQ ID NO: 356 - DNA, 25 bp, Artificial sequence
  Synthetic sequence: Probe suitable for detection of genetic variations associated with known erythrocyte antigens, and useful for genotyping for blood groups
accgtcggagccagcaatggcatgt

SEQ ID NO: 357 - DNA, 27 bp, Artificial sequence
  Synthetic sequence: Probe suitable for detection of genetic variations associated with known erythrocyte antigens, and useful for genotyping for blood groups
taccgtcggagccggcaatggcatgtg

SEQ ID NO: 358 - DNA, 27 bp, Artificial sequence
  Synthetic sequence: Probe suitable for detection of genetic variations associated with known erythrocyte antigens, and useful for genotyping for blood groups
taccgtcggagccagcaatggcatgtg

SEQ ID NO: 359 - DNA, 25 bp, Artificial sequence
  Synthetic sequence: Probe suitable for detection of genetic variations associated with known erythrocyte antigens, and useful for genotyping for blood groups
acatgaacatgatgcacatctacgt

SEQ ID NO: 360 - DNA, 25 bp, Artificial sequence
  Synthetic sequence: Probe suitable for detection of genetic variations associated with known erythrocyte antigens, and useful for genotyping for blood groups
acatgaacatgacgcacatctacgt

SEQ ID NO: 361 - DNA, 27 bp, Artificial sequence
  Synthetic sequence: Probe suitable for detection of genetic variations associated with known erythrocyte antigens, and useful for genotyping for blood groups
cacatgaacatgatgcacatctacgtg

SEQ ID NO: 362 - DNA, 27 bp, Artificial sequence
  Synthetic sequence: Probe suitable for detection of genetic variations associated with known erythrocyte antigens, and useful for genotyping for blood groups
cacatgaacatgacgcacatctacgtg

SEQ ID NO: 363 - DNA, 25 bp, Artificial sequence
  Synthetic sequence: Probe suitable for detection of genetic variations associated with known erythrocyte antigens, and useful for genotyping for blood groups
tggtcatcacactgttcaggtattg

SEQ ID NO: 364 - DNA, 25 bp, Artificial sequence
  Synthetic sequence: Probe suitable for detection of genetic variations associated with known erythrocyte antigens, and useful for genotyping for blood groups
tggtcatcacaccgttcaggtattg

SEQ ID NO: 365 - DNA, 23 bp, Artificial sequence
  Synthetic sequence: Probe suitable for detection of genetic variations associated with known erythrocyte antigens, and useful for genotyping for blood groups
ggtcatcacactgttcaggtatt

SEQ ID NO: 366 - DNA, 23 bp, Artificial sequence
  Synthetic sequence: Probe suitable for detection of genetic variations associated with known erythrocyte antigens, and useful for genotyping for blood groups
ggtcatcacaccgttcaggtatt

SEQ ID NO: 367 - DNA, 21 bp, Artificial sequence
  Synthetic sequence: Probe suitable for detection of genetic variations associated with known erythrocyte antigens, and useful for genotyping for blood groups
gctgtgggtacctcgtgtcac

SEQ ID NO: 368 - DNA, 21 bp, Artificial sequence
  Synthetic sequence: Probe suitable for detection of genetic variations associated with known erythrocyte antigens, and useful for genotyping for blood groups
gctgtgggtatctcgtgtcac

SEQ ID NO: 369 - DNA, 23 bp, Artificial sequence
  Synthetic sequence: Probe suitable for detection of genetic variations associated with known erythrocyte antigens, and useful for genotyping for blood groups
ggctgtgggtacctcgtgtcacc

SEQ ID NO: 370 - DNA, 23 bp, Artificial sequence
  Synthetic sequence: Probe suitable for detection of genetic variations associated with known erythrocyte antigens, and useful for genotyping for blood groups
ggctgtgggtatctcgtgtcacc

SEQ ID NO: 371 - DNA, 25 bp, Artificial sequence
  Synthetic sequence: Probe suitable for detection of genetic variations associated with known erythrocyte antigens, and useful for genotyping for blood groups
agacagactaccacatgaacatgat

SEQ ID NO: 372 - DNA, 25 bp, Artificial sequence
  Synthetic sequence: Probe suitable for detection of genetic variations associated with known erythrocyte antigens, and useful for genotyping for blood groups
agacagactaccccatgaacatgat

SEQ ID NO: 373 - DNA, 23 bp, Artificial sequence
  Synthetic sequence: Probe suitable for detection of genetic variations associated with known erythrocyte antigens, and useful for genotyping for blood groups
gacagactaccacatgaacatga

SEQ ID NO: 374 - DNA, 23 bp, Artificial sequence
  Synthetic sequence: Probe suitable for detection of genetic variations associated with known erythrocyte antigens, and useful for genotyping for blood groups
gacagactaccccatgaacatga

SEQ ID NO: 375 - DNA, 25 bp, Artificial sequence
  Synthetic sequence: Probe suitable for detection of genetic variations associated with known erythrocyte antigens, and useful for genotyping for blood groups
ctgctctgctgagaagtccaatcga

SEQ ID NO: 376 - DNA, 25 bp, Artificial sequence
  Synthetic sequence: Probe suitable for detection of genetic variations associated with known erythrocyte antigens, and useful for genotyping for blood groups
ctgctctgctgaaaagtccaatcga

SEQ ID NO: 377 - DNA, 23 bp, Artificial sequence
  Synthetic sequence: Probe suitable for detection of genetic variations associated with known erythrocyte antigens, and useful for genotyping for blood groups
tgctctgctgagaagtccaatcg

SEQ ID NO: 378 - DNA, 23 bp, Artificial sequence
  Synthetic sequence: Probe suitable for detection of genetic variations associated with known erythrocyte antigens, and useful for genotyping for blood groups
tgctctgctgaaaagtccaatcg

SEQ ID NO: 379 - DNA, 25 bp, Artificial sequence
  Synthetic sequence: Probe suitable for detection of genetic variations associated with known erythrocyte antigens, and useful for genotyping for blood groups
tgggtacctcgtgtcacctgatccc

SEQ ID NO: 380 - DNA, 25 bp, Artificial sequence
  Synthetic sequence: Probe suitable for detection of genetic variations associated with known erythrocyte antigens, and useful for genotyping for blood groups
tgggtacctcgtatcacctgatccc

SEQ ID NO: 381 - DNA, 23 bp, Artificial sequence
  Synthetic sequence: Probe suitable for detection of genetic variations associated with known erythrocyte antigens, and useful for genotyping for blood groups
gggtacctcgtgtcacctgatcc

SEQ ID NO: 382 - DNA, 23 bp, Artificial sequence
  Synthetic sequence: Probe suitable for detection of genetic variations associated with known erythrocyte antigens, and useful for genotyping for blood groups
gggtacctcgtatcacctgatcc

SEQ ID NO: 383 - DNA, 25 bp, Artificial sequence
  Synthetic sequence: Probe suitable for detection of genetic variations associated with known erythrocyte antigens, and useful for genotyping for blood groups
ttggccaagatctgaccgtgatggc

SEQ ID NO: 384 - DNA, 25 bp, Artificial sequence
  Synthetic sequence: Probe suitable for detection of genetic variations associated with known erythrocyte antigens, and useful for genotyping for blood groups
ttggccaagatccgaccgtgatggc

SEQ ID NO: 385 - DNA, 27 bp, Artificial sequence
  Synthetic sequence: Probe suitable for detection of genetic variations associated with known erythrocyte antigens, and useful for genotyping for blood groups
gttggccaagatctgaccgtgatggcg

SEQ ID NO: 386 - DNA, 27 bp, Artificial sequence
  Synthetic sequence: Probe suitable for detection of genetic variations associated with known erythrocyte antigens, and useful for genotyping for blood groups
gttggccaagatccgaccgtgatggcg

SEQ ID NO: 387 - DNA, 25 bp, Artificial sequence
  Synthetic sequence: Probe suitable for detection of genetic variations associated with known erythrocyte antigens, and useful for genotyping for blood groups
cttgataccgtcggagccggcaatg

SEQ ID NO: 388 - DNA, 25 bp, Artificial sequence
  Synthetic sequence: Probe suitable for detection of genetic variations associated with known erythrocyte antigens, and useful for genotyping for blood groups
cttgataccgtcagagccggcaatg

SEQ ID NO: 389 - DNA, 27 bp, Artificial sequence
  Synthetic sequence: Probe suitable for detection of genetic variations associated with known erythrocyte antigens, and useful for genotyping for blood groups
gcttgataccgtcggagccggcaatgg

SEQ ID NO: 390 - DNA, 27 bp, Artificial sequence
  Synthetic sequence: Probe suitable for detection of genetic variations associated with known erythrocyte antigens, and useful for genotyping for blood groups
gcttgataccgtcagagccggcaatgg

SEQ ID NO: 391 - DNA, 25 bp, Artificial sequence
  Synthetic sequence: Probe suitable for detection of genetic variations associated with known erythrocyte antigens, and useful for genotyping for blood groups
ccggcaatggcatgtgggtcactgg

SEQ ID NO: 392 - DNA, 25 bp, Artificial sequence
  Synthetic sequence: Probe suitable for detection of genetic variations associated with known erythrocyte antigens, and useful for genotyping for blood groups
ccggcaatggcacgtgggtcactgg

SEQ ID NO: 393 - DNA, 23 bp, Artificial sequence
  Synthetic sequence: Probe suitable for detection of genetic variations associated with known erythrocyte antigens, and useful for genotyping for blood groups
cggcaatggcatgtgggtcactg

SEQ ID NO: 394 - DNA, 23 bp, Artificial sequence
  Synthetic sequence: Probe suitable for detection of genetic variations associated with known erythrocyte antigens, and useful for genotyping for blood groups
cggcaatggcacgtgggtcactg

SEQ ID NO: 395 - DNA, 25 bp, Artificial sequence
  Synthetic sequence: Probe suitable for detection of genetic variations associated with known erythrocyte antigens, and useful for genotyping for blood groups
ataccgtcggagccggcaatggcat

SEQ ID NO: 396 - DNA, 25 bp, Artificial sequence
  Synthetic sequence: Probe suitable for detection of genetic variations associated with known erythrocyte antigens, and useful for genotyping for blood groups
ataccgtcggagacggcaatggcat

SEQ ID NO: 397 - DNA, 27 bp, Artificial sequence
  Synthetic sequence: Probe suitable for detection of genetic variations associated with known erythrocyte antigens, and useful for genotyping for blood groups
gccggcaatggcatgtgggtcactggg

SEQ ID NO: 398 - DNA, 27 bp, Artificial sequence
  Synthetic sequence: Probe suitable for detection of genetic variations associated with known erythrocyte antigens, and useful for genotyping for blood groups
gccggcaatggcacgtgggtcactggg

SEQ ID NO: 399 - DNA, 25 bp, Artificial sequence
  Synthetic sequence: Probe suitable for detection of genetic variations associated with known erythrocyte antigens, and useful for genotyping for blood groups
gcgtggctgtgggtacctcgtgtca

SEQ ID NO: 400 - DNA, 25 bp, Artificial sequence
  Synthetic sequence: Probe suitable for detection of genetic variations associated with known erythrocyte antigens, and useful for genotyping for blood groups
gcgtggctgtggatacctcgtgtca

SEQ ID NO: 401 - DNA, 27 bp, Artificial sequence
  Synthetic sequence: Probe suitable for detection of genetic variations associated with known erythrocyte antigens, and useful for genotyping for blood groups
gataccgtcggagccggcaatggcatg

SEQ ID NO: 402 - DNA, 27 bp, Artificial sequence
  Synthetic sequence: Probe suitable for detection of genetic variations associated with known erythrocyte antigens, and useful for genotyping for blood groups
gataccgtcggagacggcaatggcatg

SEQ ID NO: 403 - DNA, 25 bp, Artificial sequence
  Synthetic sequence: Probe suitable for detection of genetic variations associated with known erythrocyte antigens, and useful for genotyping for blood groups
tgcagacttatgtgcacagtgcggt

SEQ ID NO: 404 - DNA, 25 bp, Artificial sequence
  Synthetic sequence: Probe suitable for detection of genetic variations associated with known erythrocyte antigens, and useful for genotyping for blood groups
tgcagacttatgggcacagtgcggt

SEQ ID NO: 405 - DNA, 23 bp, Artificial sequence
  Synthetic sequence: Probe suitable for detection of genetic variations associated with known erythrocyte antigens, and useful for genotyping for blood groups
gcagacttatgtgcacagtgcgg

SEQ ID NO: 406 - DNA, 23 bp, Artificial sequence
  Synthetic sequence: Probe suitable for detection of genetic variations associated with known erythrocyte antigens, and useful for genotyping for blood groups
gcagacttatgggcacagtgcgg

SEQ ID NO: 407 - DNA, 25 bp, Artificial sequence
  Synthetic sequence: Probe suitable for detection of genetic variations associated with known erythrocyte antigens, and useful for genotyping for blood groups
gcatttaaacaggtttgctcctaaa

SEQ ID NO: 408 - DNA, 25 bp, Artificial sequence
  Synthetic sequence: Probe suitable for detection of genetic variations associated with known erythrocyte antigens, and useful for genotyping for blood groups
gcatttaaacagctttgctcctaaa

SEQ ID NO: 409 - DNA, 27 bp, Artificial sequence
  Synthetic sequence: Probe suitable for detection of genetic variations associated with known erythrocyte antigens, and useful for genotyping for blood groups
tgcatttaaacaggtttgctcctaaat

SEQ ID NO: 410 - DNA, 27 bp, Artificial sequence
  Synthetic sequence: Probe suitable for detection of genetic variations associated with known erythrocyte antigens, and useful for genotyping for blood groups
tgcatttaaacagctttgctcctaaat

SEQ ID NO: 411 - DNA, 25 bp, Artificial sequence
  Synthetic sequence: Probe suitable for detection of genetic variations associated with known erythrocyte antigens, and useful for genotyping for blood groups
acaggatgagctctaagtacccgcg

SEQ ID NO: 412 - DNA, 25 bp, Artificial sequence
  Synthetic sequence: Probe suitable for detection of genetic variations associated with known erythrocyte antigens, and useful for genotyping for blood groups
acaggatgagctgtaagtacccgcg

SEQ ID NO: 413 - DNA, 27 bp, Artificial sequence
  Synthetic sequence: Probe suitable for detection of genetic variations associated with known erythrocyte antigens, and useful for genotyping for blood groups
cacaggatgagctctaagtacccgcgg

SEQ ID NO: 414 - DNA, 27 bp, Artificial sequence
  Synthetic sequence: Probe suitable for detection of genetic variations associated with known erythrocyte antigens, and useful for genotyping for blood groups
cacaggatgagctgtaagtacccgcgg

SEQ ID NO: 415 - DNA, 25 bp, Artificial sequence
  Synthetic sequence: Probe suitable for detection of genetic variations associated with known erythrocyte antigens, and useful for genotyping for blood groups
tggaggtgacagctttaggcaacct

SEQ ID NO: 416 - DNA, 25 bp, Artificial sequence
  Synthetic sequence: Probe suitable for detection of genetic variations associated with known erythrocyte antigens, and useful for genotyping for blood groups
tggaggtgacagatttaggcaacct

SEQ ID NO: 417 - DNA, 23 bp, Artificial sequence
  Synthetic sequence: Probe suitable for detection of genetic variations associated with known erythrocyte antigens, and useful for genotyping for blood groups
ggaggtgacagctttaggcaacc

SEQ ID NO: 418 - DNA, 23 bp, Artificial sequence
  Synthetic sequence: Probe suitable for detection of genetic variations associated with known erythrocyte antigens, and useful for genotyping for blood groups
ggaggtgacagatttaggcaacc

SEQ ID NO: 419 - DNA, 25 bp, Artificial sequence
  Synthetic sequence: Probe suitable for detection of genetic variations associated with known erythrocyte antigens, and useful for genotyping for blood groups
tgggtctgcttggagagatcatcta

SEQ ID NO: 420 - DNA, 25 bp, Artificial sequence
  Synthetic sequence: Probe suitable for detection of genetic variations associated with known erythrocyte antigens, and useful for genotyping for blood groups
tgggtctgcttgaagagatcatcta

SEQ ID NO: 421 - DNA, 23 bp, Artificial sequence
  Synthetic sequence: Probe suitable for detection of genetic variations associated with known erythrocyte antigens, and useful for genotyping for blood groups
gggtctgcttggagagatcatct

SEQ ID NO: 422 - DNA, 23 bp, Artificial sequence
  Synthetic sequence: Probe suitable for detection of genetic variations associated with known erythrocyte antigens, and useful for genotyping for blood groups
gggtctgcttgaagagatcatct

SEQ ID NO: 423 - DNA, 25 bp, Artificial sequence
  Synthetic sequence: Probe suitable for detection of genetic variations associated with known erythrocyte antigens, and useful for genotyping for blood groups
tcccccagtattcggctggccacca

SEQ ID NO: 424 - DNA, 25 bp, Artificial sequence
  Synthetic sequence: Probe suitable for detection of genetic variations associated with known erythrocyte antigens, and useful for genotyping for blood groups
tcccccagtatttggctggccacca

SEQ ID NO: 425 - DNA, 27 bp, Artificial sequence
  Synthetic sequence: Probe suitable for detection of genetic variations associated with known erythrocyte antigens, and useful for genotyping for blood groups
ctcccccagtattcggctggccaccat

SEQ ID NO: 426 - DNA, 27 bp, Artificial sequence
  Synthetic sequence: Probe suitable for detection of genetic variations associated with known erythrocyte antigens, and useful for genotyping for blood groups
ctcccccagtatttggctggccaccat

SEQ ID NO: 427 - DNA, 25 bp, Artificial sequence
  Synthetic sequence: Probe suitable for detection of genetic variations associated with known erythrocyte antigens, and useful for genotyping for blood groups
tttgcagacttatgtgcacagtgcg

SEQ ID NO: 428 - DNA, 25 bp, Artificial sequence
  Synthetic sequence: Probe suitable for detection of genetic variations associated with known erythrocyte antigens, and useful for genotyping for blood groups
tttgcagacttaggtgcacagtgcg

SEQ ID NO: 429 - DNA, 23 bp, Artificial sequence
  Synthetic sequence: Probe suitable for detection of genetic variations associated with known erythrocyte antigens, and useful for genotyping for blood groups
ttgcagacttatgtgcacagtgc

SEQ ID NO: 430 - DNA, 23 bp, Artificial sequence
  Synthetic sequence: Probe suitable for detection of genetic variations associated with known erythrocyte antigens, and useful for genotyping for blood groups
ttgcagacttaggtgcacagtgc

SEQ ID NO: 431 - DNA, 25 bp, Artificial sequence
  Synthetic sequence: Probe suitable for detection of genetic variations associated with known erythrocyte antigens, and useful for genotyping for blood groups
agttttctggaaggtaagatttttc

SEQ ID NO: 432 - DNA, 25 bp, Artificial sequence
  Synthetic sequence: Probe suitable for detection of genetic variations associated with known erythrocyte antigens, and useful for genotyping for blood groups
agttttctggaaagtaagatttttc

SEQ ID NO: 433 - DNA, 27 bp, Artificial sequence
  Synthetic sequence: Probe suitable for detection of genetic variations associated with known erythrocyte antigens, and useful for genotyping for blood groups
aagttttctggaaggtaagatttttca

SEQ ID NO: 434 - DNA, 27 bp, Artificial sequence
  Synthetic sequence: Probe suitable for detection of genetic variations associated with known erythrocyte antigens, and useful for genotyping for blood groups
aagttttctggaaagtaagatttttca

SEQ ID NO: 435 - DNA, 25 bp, Artificial sequence
  Synthetic sequence: Probe suitable for detection of genetic variations associated with known erythrocyte antigens, and useful for genotyping for blood groups
cctgcccctctgggccctaacactg

SEQ ID NO: 436 - DNA, 25 bp, Artificial sequence
  Synthetic sequence: Probe suitable for detection of genetic variations associated with known erythrocyte antigens, and useful for genotyping for blood groups
cctgcccctctgagccctaacactg

SEQ ID NO: 437 - DNA, 23 bp, Artificial sequence
  Synthetic sequence: Probe suitable for detection of genetic variations associated with known erythrocyte antigens, and useful for genotyping for blood groups
ctgcccctctgggccctaacact

SEQ ID NO: 438 - DNA, 23 bp, Artificial sequence
  Synthetic sequence: Probe suitable for detection of genetic variations associated with known erythrocyte antigens, and useful for genotyping for blood groups
ctgcccctctgagccctaacact

SEQ ID NO: 439 - DNA, 25 bp, Artificial sequence
  Synthetic sequence: Probe suitable for detection of genetic variations associated with known erythrocyte antigens, and useful for genotyping for blood groups
tccttagaggatcaaaaggggctcg

SEQ ID NO: 440 - DNA, 25 bp, Artificial sequence
  Synthetic sequence: Probe suitable for detection of genetic variations associated with known erythrocyte antigens, and useful for genotyping for blood groups
tccttagaggattaaaaggggctcg

SEQ ID NO: 441 - DNA, 23 bp, Artificial sequence
  Synthetic sequence: Probe suitable for detection of genetic variations associated with known erythrocyte antigens, and useful for genotyping for blood groups
ccttagaggatcaaaaggggctc

SEQ ID NO: 442 - DNA, 23 bp, Artificial sequence
  Synthetic sequence: Probe suitable for detection of genetic variations associated with known erythrocyte antigens, and useful for genotyping for blood groups
ccttagaggattaaaaggggctc

SEQ ID NO: 443 - DNA, 25 bp, Artificial sequence
  Synthetic sequence: Probe suitable for detection of genetic variations associated with known erythrocyte antigens, and useful for genotyping for blood groups
tggtgtgcagtgggcaatcctgctg

SEQ ID NO: 444 - DNA, 25 bp, Artificial sequence
  Synthetic sequence: Probe suitable for detection of genetic variations associated with known erythrocyte antigens, and useful for genotyping for blood groups
tggtgtgcagtgagcaatcctgctg

SEQ ID NO: 445 - DNA, 23 bp, Artificial sequence
  Synthetic sequence: Probe suitable for detection of genetic variations associated with known erythrocyte antigens, and useful for genotyping for blood groups
ggtgtgcagtgggcaatcctgct

SEQ ID NO: 446 - DNA, 23 bp, Artificial sequence
  Synthetic sequence: Probe suitable for detection of genetic variations associated with known erythrocyte antigens, and useful for genotyping for blood groups
ggtgtgcagtgagcaatcctgct

SEQ ID NO: 447 - DNA, 25 bp, Artificial sequence
  Synthetic sequence: Probe suitable for detection of genetic variations associated with known erythrocyte antigens, and useful for genotyping for blood groups
aatatcttcaacgtgagtcatggtg

SEQ ID NO: 448 - DNA, 25 bp, Artificial sequence
  Synthetic sequence: Probe suitable for detection of genetic variations associated with known erythrocyte antigens, and useful for genotyping for blood groups
aatatcttcaacatgagtcatggtg

SEQ ID NO: 449 - DNA, 23 bp, Artificial sequence
  Synthetic sequence: Probe suitable for detection of genetic variations associated with known erythrocyte antigens, and useful for genotyping for blood groups
atatcttcaacgtgagtcatggt

SEQ ID NO: 450 - DNA, 23 bp, Artificial sequence
  Synthetic sequence: Probe suitable for detection of genetic variations associated with known erythrocyte antigens, and useful for genotyping for blood groups
atatcttcaacatgagtcatggt

SEQ ID NO: 451 - DNA, 25 bp, Artificial sequence
  Synthetic sequence: Probe suitable for detection of genetic variations associated with known erythrocyte antigens, and useful for genotyping for blood groups
tttattgcagacagactaccacatg

SEQ ID NO: 452 - DNA, 25 bp, Artificial sequence
  Synthetic sequence: Probe suitable for detection of genetic variations associated with known erythrocyte antigens, and useful for genotyping for blood groups
tttattgcagactaccacatgaaca

SEQ ID NO: 453 - DNA, 23 bp, Artificial sequence
  Synthetic sequence: Probe suitable for detection of genetic variations associated with known erythrocyte antigens, and useful for genotyping for blood groups
ttattgcagacagactaccacat

SEQ ID NO: 454 - DNA, 23 bp, Artificial sequence
  Synthetic sequence: Probe suitable for detection of genetic variations associated with known erythrocyte antigens, and useful for genotyping for blood groups
ttattgcagactaccacatgaac

SEQ ID NO: 455 - DNA, 23 bp, Artificial sequence
  Synthetic sequence: Probe suitable for detection of genetic variations associated with known erythrocyte antigens, and useful for genotyping for blood groups
ctggcccccaggcgccctcttct

SEQ ID NO: 456 - DNA, 23 bp, Artificial sequence
  Synthetic sequence: Probe suitable for detection of genetic variations associated with known erythrocyte antigens, and useful for genotyping for blood groups
ctggcccccagtcgccctcttct

SEQ ID NO: 457 - DNA, 21 bp, Artificial sequence
  Synthetic sequence: Probe suitable for detection of genetic variations associated with known erythrocyte antigens, and useful for genotyping for blood groups
tggcccccaggcgccctcttc

SEQ ID NO: 458 - DNA, 21 bp, Artificial sequence
  Synthetic sequence: Probe suitable for detection of genetic variations associated with known erythrocyte antigens, and useful for genotyping for blood groups
tggcccccagtcgccctcttc

SEQ ID NO: 459 - DNA, 25 bp, Artificial sequence
  Synthetic sequence: Probe suitable for detection of genetic variations associated with known erythrocyte antigens, and useful for genotyping for blood groups
aaggaagaatgccgtgttcaacacc

SEQ ID NO: 460 - DNA, 25 bp, Artificial sequence
  Synthetic sequence: Probe suitable for detection of genetic variations associated with known erythrocyte antigens, and useful for genotyping for blood groups
aaggaagaatgcgtgttcaacacct

SEQ ID NO: 461 - DNA, 23 bp, Artificial sequence
  Synthetic sequence: Probe suitable for detection of genetic variations associated with known erythrocyte antigens, and useful for genotyping for blood groups
aggaagaatgccgtgttcaacac

SEQ ID NO: 462 - DNA, 23 bp, Artificial sequence
  Synthetic sequence: Probe suitable for detection of genetic variations associated with known erythrocyte antigens, and useful for genotyping for blood groups
aggaagaatgcgtgttcaacacc

SEQ ID NO: 463 - DNA, 19 bp, Artificial sequence
  Synthetic sequence: Probe suitable for detection of genetic variations associated with known erythrocyte antigens, and useful for genotyping for blood groups
gcttgccatggtgctgggt

SEQ ID NO: 464 - DNA, 19 bp, Artificial sequence
  Synthetic sequence: Probe suitable for detection of genetic variations associated with known erythrocyte antigens, and useful for genotyping for blood groups
gcttgccattgtgctgggt

SEQ ID NO: 465 - DNA, 21 bp, Artificial sequence
  Synthetic sequence: Probe suitable for detection of genetic variations associated with known erythrocyte antigens, and useful for genotyping for blood groups
ggcttgccatggtgctgggtc

SEQ ID NO: 466 - DNA, 21 bp, Artificial sequence
  Synthetic sequence: Probe suitable for detection of genetic variations associated with known erythrocyte antigens, and useful for genotyping for blood groups
ggcttgccattgtgctgggtc

SEQ ID NO: 467 - DNA, 25 bp, Artificial sequence
  Synthetic sequence: Probe suitable for detection of genetic variations associated with known erythrocyte antigens, and useful for genotyping for blood groups
cttgtggctgggctgatctccgtcg

SEQ ID NO: 468 - DNA, 25 bp, Artificial sequence
  Synthetic sequence: Probe suitable for detection of genetic variations associated with known erythrocyte antigens, and useful for genotyping for blood groups
cttgtggctgggggctctgatctcc

SEQ ID NO: 469 - DNA, 23 bp, Artificial sequence
  Synthetic sequence: Probe suitable for detection of genetic variations associated with known erythrocyte antigens, and useful for genotyping for blood groups
ttgtggctgggctgatctccgtc

SEQ ID NO: 470 - DNA, 23 bp, Artificial sequence
  Synthetic sequence: Probe suitable for detection of genetic variations associated with known erythrocyte antigens, and useful for genotyping for blood groups
ttgtggctgggggctctgatctc

SEQ ID NO: 471 - DNA, 25 bp, Artificial sequence
  Synthetic sequence: Probe suitable for detection of genetic variations associated with known erythrocyte antigens, and useful for genotyping for blood groups
agtacctgccggtaagaaactagac

SEQ ID NO: 472 - DNA, 25 bp, Artificial sequence
  Synthetic sequence: Probe suitable for detection of genetic variations associated with known erythrocyte antigens, and useful for genotyping for blood groups
agtacctgccggaaactagacaact

SEQ ID NO: 473 - DNA, 23 bp, Artificial sequence
  Synthetic sequence: Probe suitable for detection of genetic variations associated with known erythrocyte antigens, and useful for genotyping for blood groups
gtacctgccggtaagaaactaga

SEQ ID NO: 474 - DNA, 23 bp, Artificial sequence
  Synthetic sequence: Probe suitable for detection of genetic variations associated with known erythrocyte antigens, and useful for genotyping for blood groups
gtacctgccggaaactagacaac

SEQ ID NO: 475 - DNA, 25 bp, Artificial sequence
  Synthetic sequence: Probe suitable for detection of genetic variations associated with known erythrocyte antigens, and useful for genotyping for blood groups
cttgtccacaggggtgttgtaaccg

SEQ ID NO: 476 - DNA, 25 bp, Artificial sequence
  Synthetic sequence: Probe suitable for detection of genetic variations associated with known erythrocyte antigens, and useful for genotyping for blood groups
cttgtccacaggtgtgttgtaaccg

SEQ ID NO: 477 - DNA, 23 bp, Artificial sequence
  Synthetic sequence: Probe suitable for detection of genetic variations associated with known erythrocyte antigens, and useful for genotyping for blood groups
ttgtccacaggggtgttgtaacc

SEQ ID NO: 478 - DNA, 23 bp, Artificial sequence
  Synthetic sequence: Probe suitable for detection of genetic variations associated with known erythrocyte antigens, and useful for genotyping for blood groups
ttgtccacaggtgtgttgtaacc

SEQ ID NO: 479 - DNA, 25 bp, Artificial sequence
  Synthetic sequence: Probe suitable for detection of genetic variations associated with known erythrocyte antigens, and useful for genotyping for blood groups
catcatgggctacaacttcagcttg

SEQ ID NO: 480 - DNA, 25 bp, Artificial sequence
  Synthetic sequence: Probe suitable for detection of genetic variations associated with known erythrocyte antigens, and useful for genotyping for blood groups
catcatgggctagaacttcagcttg

SEQ ID NO: 481 - DNA, 23 bp, Artificial sequence
  Synthetic sequence: Probe suitable for detection of genetic variations associated with known erythrocyte antigens, and useful for genotyping for blood groups
atcatgggctacaacttcagctt

SEQ ID NO: 482 - DNA, 23 bp, Artificial sequence
  Synthetic sequence: Probe suitable for detection of genetic variations associated with known erythrocyte antigens, and useful for genotyping for blood groups
atcatgggctagaacttcagctt

SEQ ID NO: 483 - DNA, 25 bp, Artificial sequence
  Synthetic sequence: Probe suitable for detection of genetic variations associated with known erythrocyte antigens, and useful for genotyping for blood groups
gtctcctgacaggtcagtgtgaggc

SEQ ID NO: 484 - DNA, 25 bp, Artificial sequence
  Synthetic sequence: Probe suitable for detection of genetic variations associated with known erythrocyte antigens, and useful for genotyping for blood groups
gtctcctgacagatcagtgtgaggc

SEQ ID NO: 485 - DNA, 23 bp, Artificial sequence
  Synthetic sequence: Probe suitable for detection of genetic variations associated with known erythrocyte antigens, and useful for genotyping for blood groups
tctcctgacaggtcagtgtgagg

SEQ ID NO: 486 - DNA, 23 bp, Artificial sequence
  Synthetic sequence: Probe suitable for detection of genetic variations associated with known erythrocyte antigens, and useful for genotyping for blood groups
tctcctgacagatcagtgtgagg

SEQ ID NO: 487 - DNA, 23 bp, Artificial sequence
  Synthetic sequence: Probe suitable for detection of genetic variations associated with known erythrocyte antigens, and useful for genotyping for blood groups
ggtcaacttggcgcagttggtgg

SEQ ID NO: 488 - DNA, 23 bp, Artificial sequence
  Synthetic sequence: Probe suitable for detection of genetic variations associated with known erythrocyte antigens, and useful for genotyping for blood groups
ggtcaacttggtgcagttggtgg

SEQ ID NO: 489 - DNA, 21 bp, Artificial sequence
  Synthetic sequence: Probe suitable for detection of genetic variations associated with known erythrocyte antigens, and useful for genotyping for blood groups
gtcaacttggcgcagttggtg

SEQ ID NO: 490 - DNA, 21 bp, Artificial sequence
  Synthetic sequence: Probe suitable for detection of genetic variations associated with known erythrocyte antigens, and useful for genotyping for blood groups
gtcaacttggtgcagttggtg

SEQ ID NO: 491 - DNA, 25 bp, Artificial sequence
  Synthetic sequence: Probe suitable for detection of genetic variations associated with known erythrocyte antigens, and useful for genotyping for blood groups
cagctttaggcaacctgaggatggt

SEQ ID NO: 492 - DNA, 25 bp, Artificial sequence
  Synthetic sequence: Probe suitable for detection of genetic variations associated with known erythrocyte antigens, and useful for genotyping for blood groups
cagctttaggcaccctgaggatggt

SEQ ID NO: 493 - DNA, 27 bp, Artificial sequence
  Synthetic sequence: Probe suitable for detection of genetic variations associated with known erythrocyte antigens, and useful for genotyping for blood groups
acagctttaggcaacctgaggatggtc

SEQ ID NO: 494 - DNA, 27 bp, Artificial sequence
  Synthetic sequence: Probe suitable for detection of genetic variations associated with known erythrocyte antigens, and useful for genotyping for blood groups
acagctttaggcaccctgaggatggtc

SEQ ID NO: 495 - DNA, 21 bp, Artificial sequence
  Synthetic sequence: Probe suitable for detection of genetic variations associated with known erythrocyte antigens, and useful for genotyping for blood groups
ctggccaagtttcaactctgc

SEQ ID NO: 496 - DNA, 21 bp, Artificial sequence
  Synthetic sequence: Probe suitable for detection of genetic variations associated with known erythrocyte antigens, and useful for genotyping for blood groups
ctggccaagtgtcaactctgc

SEQ ID NO: 497 - DNA, 19 bp, Artificial sequence
  Synthetic sequence: Probe suitable for detection of genetic variations associated with known erythrocyte antigens, and useful for genotyping for blood groups
tggccaagtttcaactctg

SEQ ID NO: 498 - DNA, 19 bp, Artificial sequence
  Synthetic sequence: Probe suitable for detection of genetic variations associated with known erythrocyte antigens, and useful for genotyping for blood groups
tggccaagtgtcaactctg

SEQ ID NO: 499 - DNA, 23 bp, Artificial sequence
  Synthetic sequence: Probe suitable for detection of genetic variations associated with known erythrocyte antigens, and useful for genotyping for blood groups
ggctgatctccgtcgggggagcc

SEQ ID NO: 500 - DNA, 23 bp, Artificial sequence
  Synthetic sequence: Probe suitable for detection of genetic variations associated with known erythrocyte antigens, and useful for genotyping for blood groups
ggctgatctccatcgggggagcc

SEQ ID NO: 501 - DNA, 21 bp, Artificial sequence
  Synthetic sequence: Probe suitable for detection of genetic variations associated with known erythrocyte antigens, and useful for genotyping for blood groups
gctgatctccgtcgggggagc

SEQ ID NO: 502 - DNA, 21 bp, Artificial sequence
  Synthetic sequence: Probe suitable for detection of genetic variations associated with known erythrocyte antigens, and useful for genotyping for blood groups
gctgatctccatcgggggagc

SEQ ID NO: 503 - DNA, 25 bp, Artificial sequence
  Synthetic sequence: Probe suitable for detection of genetic variations associated with known erythrocyte antigens, and useful for genotyping for blood groups
ggggagccaagtacctgccggtaag

SEQ ID NO: 504 - DNA, 25 bp, Artificial sequence
  Synthetic sequence: Probe suitable for detection of genetic variations associated with known erythrocyte antigens, and useful for genotyping for blood groups
ggggagccaagtgcctgccggtaag

SEQ ID NO: 505 - DNA, 23 bp, Artificial sequence
  Synthetic sequence: Probe suitable for detection of genetic variations associated with known erythrocyte antigens, and useful for genotyping for blood groups
gggagccaagtacctgccggtaa

SEQ ID NO: 506 - DNA, 23 bp, Artificial sequence
  Synthetic sequence: Probe suitable for detection of genetic variations associated with known erythrocyte antigens, and useful for genotyping for blood groups
gggagccaagtgcctgccggtaa

SEQ ID NO: 507 - DNA, 21 bp, Artificial sequence
  Synthetic sequence: Probe suitable for detection of genetic variations associated with known erythrocyte antigens, and useful for genotyping for blood groups
gcacctcatgaggctaaatat

SEQ ID NO: 508 - DNA, 21 bp, Artificial sequence
  Synthetic sequence: Probe suitable for detection of genetic variations associated with known erythrocyte antigens, and useful for genotyping for blood groups
gcacctcatgtggctaaatat

SEQ ID NO: 509 - DNA, 23 bp, Artificial sequence
  Synthetic sequence: Probe suitable for detection of genetic variations associated with known erythrocyte antigens, and useful for genotyping for blood groups
agcacctcatgaggctaaatatt

SEQ ID NO: 510 - DNA, 23 bp, Artificial sequence
  Synthetic sequence: Probe suitable for detection of genetic variations associated with known erythrocyte antigens, and useful for genotyping for blood groups
agcacctcatgtggctaaatatt

SEQ ID NO: 511 - DNA, 25 bp, Artificial sequence
  Synthetic sequence: Probe suitable for detection of genetic variations associated with known erythrocyte antigens, and useful for genotyping for blood groups
aacatgatgcacatctacgtgttcg

SEQ ID NO: 512 - DNA, 25 bp, Artificial sequence
  Synthetic sequence: Probe suitable for detection of genetic variations associated with known erythrocyte antigens, and useful for genotyping for blood groups
aacctgaggcacttctacgtgttcg

SEQ ID NO: 513 - DNA, 23 bp, Artificial sequence
  Synthetic sequence: Probe suitable for detection of genetic variations associated with known erythrocyte antigens, and useful for genotyping for blood groups
acatgatgcacatctacgtgttc

SEQ ID NO: 514 - DNA, 23 bp, Artificial sequence
  Synthetic sequence: Probe suitable for detection of genetic variations associated with known erythrocyte antigens, and useful for genotyping for blood groups
acctgaggcacttctacgtgttc

SEQ ID NO: 515 - DNA, 25 bp, Artificial sequence
  Synthetic sequence: Probe suitable for detection of genetic variations associated with known erythrocyte antigens, and useful for genotyping for blood groups
agccagttcccttctgggaaggtgg

SEQ ID NO: 516 - DNA, 25 bp, Artificial sequence
  Synthetic sequence: Probe suitable for detection of genetic variations associated with known erythrocyte antigens, and useful for genotyping for blood groups
agccagttccctcctgggaaggtgg

SEQ ID NO: 517 - DNA, 27 bp, Artificial sequence
  Synthetic sequence: Probe suitable for detection of genetic variations associated with known erythrocyte antigens, and useful for genotyping for blood groups
gagccagttcccttctgggaaggtggt

SEQ ID NO: 518 - DNA, 27 bp, Artificial sequence
  Synthetic sequence: Probe suitable for detection of genetic variations associated with known erythrocyte antigens, and useful for genotyping for blood groups
gagccagttccctcctgggaaggtggt

SEQ ID NO: 519 - DNA, 23 bp, Artificial sequence
  Synthetic sequence: Probe suitable for detection of genetic variations associated with known erythrocyte antigens, and useful for genotyping for blood groups
cttagaggatcaaaaggggctcg

SEQ ID NO: 520 - DNA, 23 bp, Artificial sequence
  Synthetic sequence: Probe suitable for detection of genetic variations associated with known erythrocyte antigens, and useful for genotyping for blood groups
cttagaggatcgaaaggggctcg

SEQ ID NO: 521 - DNA, 21 bp, Artificial sequence
  Synthetic sequence: Probe suitable for detection of genetic variations associated with known erythrocyte antigens, and useful for genotyping for blood groups
ttagaggatcaaaaggggctc

SEQ ID NO: 522 - DNA, 21 bp, Artificial sequence
  Synthetic sequence: Probe suitable for detection of genetic variations associated with known erythrocyte antigens, and useful for genotyping for blood groups
ttagaggatcgaaaggggctc

SEQ ID NO: 523 - DNA, 25 bp, Artificial sequence
  Synthetic sequence: Probe suitable for detection of genetic variations associated with known erythrocyte antigens, and useful for genotyping for blood groups
acccactatgacgcttccttagagg

SEQ ID NO: 524 - DNA, 25 bp, Artificial sequence
  Synthetic sequence: Probe suitable for detection of genetic variations associated with known erythrocyte antigens, and useful for genotyping for blood groups
acccactatgacacttccttagagg

SEQ ID NO: 525 - DNA, 27 bp, Artificial sequence
  Synthetic sequence: Probe suitable for detection of genetic variations associated with known erythrocyte antigens, and useful for genotyping for blood groups
tacccactatgacgcttccttagagga

SEQ ID NO: 526 - DNA, 27 bp, Artificial sequence
  Synthetic sequence: Probe suitable for detection of genetic variations associated with known erythrocyte antigens, and useful for genotyping for blood groups
tacccactatgacacttccttagagga

SEQ ID NO: 527 - DNA, 25 bp, Artificial sequence
  Synthetic sequence: Probe suitable for detection of genetic variations associated with known erythrocyte antigens, and useful for genotyping for blood groups
agtgtcaactctcctctgctgagaa

SEQ ID NO: 528 - DNA, 25 bp, Artificial sequence
  Synthetic sequence: Probe suitable for detection of genetic variations associated with known erythrocyte antigens, and useful for genotyping for blood groups
agtgtcaactctgctctgctgagaa

SEQ ID NO: 529 - DNA, 27 bp, Artificial sequence
  Synthetic sequence: Probe suitable for detection of genetic variations associated with known erythrocyte antigens, and useful for genotyping for blood groups
aagtgtcaactctcctctgctgagaag

SEQ ID NO: 530 - DNA, 27 bp, Artificial sequence
  Synthetic sequence: Probe suitable for detection of genetic variations associated with known erythrocyte antigens, and useful for genotyping for blood groups
aagtgtcaactctgctctgctgagaag

SEQ ID NO: 531 - DNA, 25 bp, Artificial sequence
  Synthetic sequence: Probe suitable for detection of genetic variations associated with known erythrocyte antigens, and useful for genotyping for blood groups
acctactatgctctagcagtcagtg

SEQ ID NO: 532 - DNA, 25 bp, Artificial sequence
  Synthetic sequence: Probe suitable for detection of genetic variations associated with known erythrocyte antigens, and useful for genotyping for blood groups
acctactatgctgtagcagtcagtg

SEQ ID NO: 533 - DNA, 27 bp, Artificial sequence
  Synthetic sequence: Probe suitable for detection of genetic variations associated with known erythrocyte antigens, and useful for genotyping for blood groups
cacctactatgctctagcagtcagtgt

SEQ ID NO: 534 - DNA, 27 bp, Artificial sequence
  Synthetic sequence: Probe suitable for detection of genetic variations associated with known erythrocyte antigens, and useful for genotyping for blood groups
cacctactatgctgtagcagtcagtgt

SEQ ID NO: 535 - DNA, 25 bp, Artificial sequence
  Synthetic sequence: Probe suitable for detection of genetic variations associated with known erythrocyte antigens, and useful for genotyping for blood groups
ttcagcttgctgggtcttgcttgga

SEQ ID NO: 536 - DNA, 25 bp, Artificial sequence
  Synthetic sequence: Probe suitable for detection of genetic variations associated with known erythrocyte antigens, and useful for genotyping for blood groups
ttcagcttgctgtgtcttgcttgga

SEQ ID NO: 537 - DNA, 27 bp, Artificial sequence
  Synthetic sequence: Probe suitable for detection of genetic variations associated with known erythrocyte antigens, and useful for genotyping for blood groups
cttcagcttgctgggtcttgcttggag

SEQ ID NO: 538 - DNA, 27 bp, Artificial sequence
  Synthetic sequence: Probe suitable for detection of genetic variations associated with known erythrocyte antigens, and useful for genotyping for blood groups
cttcagcttgctgtgtcttgcttggag

SEQ ID NO: 539 - DNA, 25 bp, Artificial sequence
  Synthetic sequence: Probe suitable for detection of genetic variations associated with known erythrocyte antigens, and useful for genotyping for blood groups
agaagtctcagcattcggttaaagt

SEQ ID NO: 540 - DNA, 25 bp, Artificial sequence
  Synthetic sequence: Probe suitable for detection of genetic variations associated with known erythrocyte antigens, and useful for genotyping for blood groups
agaagtctcagcgttcggttaaagt

SEQ ID NO: 541 - DNA, 27 bp, Artificial sequence
  Synthetic sequence: Probe suitable for detection of genetic variations associated with known erythrocyte antigens, and useful for genotyping for blood groups
cagaagtctcagcattcggttaaagtt

SEQ ID NO: 542 - DNA, 27 bp, Artificial sequence
  Synthetic sequence: Probe suitable for detection of genetic variations associated with known erythrocyte antigens, and useful for genotyping for blood groups
cagaagtctcagcgttcggttaaagtt

SEQ ID NO: 543 - DNA, 25 bp, Artificial sequence
  Synthetic sequence: Probe suitable for detection of genetic variations associated with known erythrocyte antigens, and useful for genotyping for blood groups
aactttaaccgaacgctgagacttc

SEQ ID NO: 544 - DNA, 25 bp, Artificial sequence
  Synthetic sequence: Probe suitable for detection of genetic variations associated with known erythrocyte antigens, and useful for genotyping for blood groups
aactttaaccgatcgctgagacttc

SEQ ID NO: 545 - DNA, 27 bp, Artificial sequence
  Synthetic sequence: Probe suitable for detection of genetic variations associated with known erythrocyte antigens, and useful for genotyping for blood groups
aaactttaaccgaacgctgagacttct

SEQ ID NO: 546 - DNA, 27 bp, Artificial sequence
  Synthetic sequence: Probe suitable for detection of genetic variations associated with known erythrocyte antigens, and useful for genotyping for blood groups
aaactttaaccgatcgctgagacttct

SEQ ID NO: 547 - DNA, 25 bp, Artificial sequence
  Synthetic sequence: Probe suitable for detection of genetic variations associated with known erythrocyte antigens, and useful for genotyping for blood groups
actggaacagccatgaagtgatgga

SEQ ID NO: 548 - DNA, 25 bp, Artificial sequence
  Synthetic sequence: Probe suitable for detection of genetic variations associated with known erythrocyte antigens, and useful for genotyping for blood groups
actggaacagccgtgaagtgatgga

SEQ ID NO: 549 - DNA, 27 bp, Artificial sequence
  Synthetic sequence: Probe suitable for detection of genetic variations associated with known erythrocyte antigens, and useful for genotyping for blood groups
aactggaacagccatgaagtgatggag

SEQ ID NO: 550 - DNA, 27 bp, Artificial sequence
  Synthetic sequence: Probe suitable for detection of genetic variations associated with known erythrocyte antigens, and useful for genotyping for blood groups
aactggaacagccgtgaagtgatggag

SEQ ID NO: 551 - DNA, 25 bp, Artificial sequence
  Synthetic sequence: Probe suitable for detection of genetic variations associated with known erythrocyte antigens, and useful for genotyping for blood groups
aactggaacagccgtgaagtgatgg

SEQ ID NO: 552 - DNA, 25 bp, Artificial sequence
  Synthetic sequence: Probe suitable for detection of genetic variations associated with known erythrocyte antigens, and useful for genotyping for blood groups
aactggaacagctgtgaagtgatgg

SEQ ID NO: 553 - DNA, 27 bp, Artificial sequence
  Synthetic sequence: Probe suitable for detection of genetic variations associated with known erythrocyte antigens, and useful for genotyping for blood groups
aaactggaacagccgtgaagtgatgga

SEQ ID NO: 554 - DNA, 27 bp, Artificial sequence
  Synthetic sequence: Probe suitable for detection of genetic variations associated with known erythrocyte antigens, and useful for genotyping for blood groups
aaactggaacagctgtgaagtgatgga

SEQ ID NO: 555 - DNA, 23 bp, Artificial sequence
  Synthetic sequence: Probe suitable for detection of genetic variations associated with known erythrocyte antigens, and useful for genotyping for blood groups
tgggggctgccccgcctgtgaca

SEQ ID NO: 556 - DNA, 23 bp, Artificial sequence
  Synthetic sequence: Probe suitable for detection of genetic variations associated with known erythrocyte antigens, and useful for genotyping for blood groups
tgggggctgcctcgcctgtgaca

SEQ ID NO: 557 - DNA, 21 bp, Artificial sequence
  Synthetic sequence: Probe suitable for detection of genetic variations associated with known erythrocyte antigens, and useful for genotyping for blood groups
gggggctgccccgcctgtgac

SEQ ID NO: 558 - DNA, 21 bp, Artificial sequence
  Synthetic sequence: Probe suitable for detection of genetic variations associated with known erythrocyte antigens, and useful for genotyping for blood groups
gggggctgcctcgcctgtgac

SEQ ID NO: 559 - DNA, 25 bp, Artificial sequence
  Synthetic sequence: Probe suitable for detection of genetic variations associated with known erythrocyte antigens, and useful for genotyping for blood groups
aagatcatgtggctctgcagaaagt

SEQ ID NO: 560 - DNA, 25 bp, Artificial sequence
  Synthetic sequence: Probe suitable for detection of genetic variations associated with known erythrocyte antigens, and useful for genotyping for blood groups
aagatcatgtggttctgcagaaagt

SEQ ID NO: 561 - DNA, 27 bp, Artificial sequence
  Synthetic sequence: Probe suitable for detection of genetic variations associated with known erythrocyte antigens, and useful for genotyping for blood groups
taagatcatgtggctctgcagaaagtc

SEQ ID NO: 562 - DNA, 27 bp, Artificial sequence
  Synthetic sequence: Probe suitable for detection of genetic variations associated with known erythrocyte antigens, and useful for genotyping for blood groups
taagatcatgtggttctgcagaaagtc

SEQ ID NO: 563 - DNA, 25 bp, Artificial sequence
  Synthetic sequence: Probe suitable for detection of genetic variations associated with known erythrocyte antigens, and useful for genotyping for blood groups
gccccatttgaggacatctactttg

SEQ ID NO: 564 - DNA, 25 bp, Artificial sequence
  Synthetic sequence: Probe suitable for detection of genetic variations associated with known erythrocyte antigens, and useful for genotyping for blood groups
gccccatttgagaacatctactttg

SEQ ID NO: 565 - DNA, 23 bp, Artificial sequence
  Synthetic sequence: Probe suitable for detection of genetic variations associated with known erythrocyte antigens, and useful for genotyping for blood groups
ccccatttgaggacatctacttt

SEQ ID NO: 566 - DNA, 23 bp, Artificial sequence
  Synthetic sequence: Probe suitable for detection of genetic variations associated with known erythrocyte antigens, and useful for genotyping for blood groups
ccccatttgagaacatctacttt

SEQ ID NO: 567 - DNA, 25 bp, Artificial sequence
  Synthetic sequence: Probe suitable for detection of genetic variations associated with known erythrocyte antigens, and useful for genotyping for blood groups
tcttgccccacaggtcattaatagc

SEQ ID NO: 568 - DNA, 25 bp, Artificial sequence
  Synthetic sequence: Probe suitable for detection of genetic variations associated with known erythrocyte antigens, and useful for genotyping for blood groups
tcttgccccacaagtcattaatagc

SEQ ID NO: 569 - DNA, 25 bp, Artificial sequence
  Synthetic sequence: Probe suitable for detection of genetic variations associated with known erythrocyte antigens, and useful for genotyping for blood groups
gctattaatgacctgtggggcaaga

SEQ ID NO: 570 - DNA, 25 bp, Artificial sequence
  Synthetic sequence: Probe suitable for detection of genetic variations associated with known erythrocyte antigens, and useful for genotyping for blood groups
gctattaatgacttgtggggcaaga

SEQ ID NO: 571 - DNA, 25 bp, Artificial sequence
  Synthetic sequence: Probe suitable for detection of genetic variations associated with known erythrocyte antigens, and useful for genotyping for blood groups
ggtttcaacagctctctggcctgca

SEQ ID NO: 572 - DNA, 25 bp, Artificial sequence
  Synthetic sequence: Probe suitable for detection of genetic variations associated with known erythrocyte antigens, and useful for genotyping for blood groups
ggtttcaacagccctctggcctgca

SEQ ID NO: 573 - DNA, 27 bp, Artificial sequence
  Synthetic sequence: Probe suitable for detection of genetic variations associated with known erythrocyte antigens, and useful for genotyping for blood groups
gggtttcaacagctctctggcctgcat

SEQ ID NO: 574 - DNA, 27 bp, Artificial sequence
  Synthetic sequence: Probe suitable for detection of genetic variations associated with known erythrocyte antigens, and useful for genotyping for blood groups
gggtttcaacagccctctggcctgcat

SEQ ID NO: 575 - DNA, 25 bp, Artificial sequence
  Synthetic sequence: Probe suitable for detection of genetic variations associated with known erythrocyte antigens, and useful for genotyping for blood groups
atggagactatggtgccaacctgga

SEQ ID NO: 576 - DNA, 25 bp, Artificial sequence
  Synthetic sequence: Probe suitable for detection of genetic variations associated with known erythrocyte antigens, and useful for genotyping for blood groups
atggagactatgatgccaacctgga

SEQ ID NO: 577 - DNA, 27 bp, Artificial sequence
  Synthetic sequence: Probe suitable for detection of genetic variations associated with known erythrocyte antigens, and useful for genotyping for blood groups
gatggagactatggtgccaacctggaa

SEQ ID NO: 578 - DNA, 27 bp, Artificial sequence
  Synthetic sequence: Probe suitable for detection of genetic variations associated with known erythrocyte antigens, and useful for genotyping for blood groups
gatggagactatgatgccaacctggaa

SEQ ID NO: 579 - DNA, 25 bp, Artificial sequence
  Synthetic sequence: Probe suitable for detection of genetic variations associated with known erythrocyte antigens, and useful for genotyping for blood groups
ccttggctcttatcttggaagcaca

SEQ ID NO: 580 - DNA, 25 bp, Artificial sequence
  Synthetic sequence: Probe suitable for detection of genetic variations associated with known erythrocyte antigens, and useful for genotyping for blood groups
ccttggctcttaccttggaagcaca

SEQ ID NO: 581 - DNA, 23 bp, Artificial sequence
  Synthetic sequence: Probe suitable for detection of genetic variations associated with known erythrocyte antigens, and useful for genotyping for blood groups
cttggctcttatcttggaagcac

SEQ ID NO: 582 - DNA, 23 bp, Artificial sequence
  Synthetic sequence: Probe suitable for detection of genetic variations associated with known erythrocyte antigens, and useful for genotyping for blood groups
cttggctcttaccttggaagcac

SEQ ID NO: 583 - DNA, 19 bp, Artificial sequence
  Synthetic sequence: Probe suitable for detection of genetic variations associated with known erythrocyte antigens, and useful for genotyping for blood groups
cctctcttccgctggcagc

SEQ ID NO: 584 - DNA, 19 bp, Artificial sequence
  Synthetic sequence: Probe suitable for detection of genetic variations associated with known erythrocyte antigens, and useful for genotyping for blood groups
cctctcttccgctggcagc

SEQ ID NO: 585 - DNA, 21 bp, Artificial sequence
  Synthetic sequence: Probe suitable for detection of genetic variations associated with known erythrocyte antigens, and useful for genotyping for blood groups
acctctcttccgctggcagct

SEQ ID NO: 586 - DNA, 21 bp, Artificial sequence
  Synthetic sequence: Probe suitable for detection of genetic variations associated with known erythrocyte antigens, and useful for genotyping for blood groups
acctctcttccgctggcagct

SEQ ID NO: 587 - DNA, 25 bp, Artificial sequence
  Synthetic sequence: Probe suitable for detection of genetic variations associated with known erythrocyte antigens, and useful for genotyping for blood groups
gcatatcagcatcaagtaccactgg

SEQ ID NO: 588 - DNA, 25 bp, Artificial sequence
  Synthetic sequence: Probe suitable for detection of genetic variations associated with known erythrocyte antigens, and useful for genotyping for blood groups
gcatatcagcattaagtaccactga

SEQ ID NO: 589 - DNA, 23 bp, Artificial sequence
  Synthetic sequence: Probe suitable for detection of genetic variations associated with known erythrocyte antigens, and useful for genotyping for blood groups
catatcagcatcaagtaccactg

SEQ ID NO: 590 - DNA, 23 bp, Artificial sequence
  Synthetic sequence: Probe suitable for detection of genetic variations associated with known erythrocyte antigens, and useful for genotyping for blood groups
catatcagcattaagtaccactg

SEQ ID NO: 591 - DNA, 25 bp, Artificial sequence
  Synthetic sequence: Probe suitable for detection of genetic variations associated with known erythrocyte antigens, and useful for genotyping for blood groups
caagtaccactggtgtggcaatgca

SEQ ID NO: 592 - DNA, 25 bp, Artificial sequence
  Synthetic sequence: Probe suitable for detection of genetic variations associated with known erythrocyte antigens, and useful for genotyping for blood groups
taagtaccactgaggtggcaatgca

SEQ ID NO: 593 - DNA, 27 bp, Artificial sequence
  Synthetic sequence: Probe suitable for detection of genetic variations associated with known erythrocyte antigens, and useful for genotyping for blood groups
tcaagtaccactggtgtggcaatgcac

SEQ ID NO: 594 - DNA, 27 bp, Artificial sequence
  Synthetic sequence: Probe suitable for detection of genetic variations associated with known erythrocyte antigens, and useful for genotyping for blood groups
ttaagtaccactgaggtggcaatgcac

SEQ ID NO: 595 - DNA, 25 bp, Artificial sequence
  Synthetic sequence: Probe suitable for detection of genetic variations associated with known erythrocyte antigens, and useful for genotyping for blood groups
ttataggagaaatgggacaacttgt

SEQ ID NO: 596 - DNA, 25 bp, Artificial sequence
  Synthetic sequence: Probe suitable for detection of genetic variations associated with known erythrocyte antigens, and useful for genotyping for blood groups
ttataggagaaacgggacaacttgt

SEQ ID NO: 597 - DNA, 27 bp, Artificial sequence
  Synthetic sequence: Probe suitable for detection of genetic variations associated with known erythrocyte antigens, and useful for genotyping for blood groups
tttataggagaaatgggacaacttgtc

SEQ ID NO: 598 - DNA, 27 bp, Artificial sequence
  Synthetic sequence: Probe suitable for detection of genetic variations associated with known erythrocyte antigens, and useful for genotyping for blood groups
tttataggagaaacgggacaacttgtc

SEQ ID NO: 599 - DNA, 25 bp, Artificial sequence
  Synthetic sequence: Probe suitable for detection of genetic variations associated with known erythrocyte antigens, and useful for genotyping for blood groups
gtattattggaacgatcctcttaat

SEQ ID NO: 600 - DNA, 25 bp, Artificial sequence
  Synthetic sequence: Probe suitable for detection of genetic variations associated with known erythrocyte antigens, and useful for genotyping for blood groups
gtattattggaatgatcctcttaat

SEQ ID NO: 601 - DNA, 27 bp, Artificial sequence
  Synthetic sequence: Probe suitable for detection of genetic variations associated with known erythrocyte antigens, and useful for genotyping for blood groups
ggtattattggaacgatcctcttaatt

SEQ ID NO: 602 - DNA, 27 bp, Artificial sequence
  Synthetic sequence: Probe suitable for detection of genetic variations associated with known erythrocyte antigens, and useful for genotyping for blood groups
ggtattattggaatgatcctcttaatt

SEQ ID NO: 603 - DNA, 25 bp, Artificial sequence
  Synthetic sequence: Probe suitable for detection of genetic variations associated with known erythrocyte antigens, and useful for genotyping for blood groups
tgataaaggtgagaattcagttttt

SEQ ID NO: 604 - DNA, 25 bp, Artificial sequence
  Synthetic sequence: Probe suitable for detection of genetic variations associated with known erythrocyte antigens, and useful for genotyping for blood groups
tgataaaggtgataattcagttttt

SEQ ID NO: 605 - DNA, 25 bp, Artificial sequence
  Synthetic sequence: Probe suitable for detection of genetic variations associated with known erythrocyte antigens, and useful for genotyping for blood groups
aaaaactgaattctcacctttatca

SEQ ID NO: 606 - DNA, 25 bp, Artificial sequence
  Synthetic sequence: Probe suitable for detection of genetic variations associated with known erythrocyte antigens, and useful for genotyping for blood groups
aaaaactgaattatcacctttatca

SEQ ID NO: 607 - DNA, 25 bp, Artificial sequence
  Synthetic sequence: Probe suitable for detection of genetic variations associated with known erythrocyte antigens, and useful for genotyping for blood groups
tatatgcagatacgcacaaacggga

SEQ ID NO: 608 - DNA, 25 bp, Artificial sequence
  Synthetic sequence: Probe suitable for detection of genetic variations associated with known erythrocyte antigens, and useful for genotyping for blood groups
tatatgcagataagcacaaacggga

SEQ ID NO: 609 - DNA, 27 bp, Artificial sequence
  Synthetic sequence: Probe suitable for detection of genetic variations associated with known erythrocyte antigens, and useful for genotyping for blood groups
ttatatgcagatacgcacaaacgggac

SEQ ID NO: 610 - DNA, 27 bp, Artificial sequence
  Synthetic sequence: Probe suitable for detection of genetic variations associated with known erythrocyte antigens, and useful for genotyping for blood groups
ttatatgcagataagcacaaacgggac

SEQ ID NO: 611 - DNA, 25 bp, Artificial sequence
  Synthetic sequence: Probe suitable for detection of genetic variations associated with known erythrocyte antigens, and useful for genotyping for blood groups
ggggaaacagttgtaacagaaattt

SEQ ID NO: 612 - DNA, 25 bp, Artificial sequence
  Synthetic sequence: Probe suitable for detection of genetic variations associated with known erythrocyte antigens, and useful for genotyping for blood groups
gggcaaacagttctaacagaaattt

SEQ ID NO: 613 - DNA, 27 bp, Artificial sequence
  Synthetic sequence: Probe suitable for detection of genetic variations associated with known erythrocyte antigens, and useful for genotyping for blood groups
aggggaaacagttgtaacagaaatttc

SEQ ID NO: 614 - DNA, 27 bp, Artificial sequence
  Synthetic sequence: Probe suitable for detection of genetic variations associated with known erythrocyte antigens, and useful for genotyping for blood groups
agggcaaacagttctaacagaaatttc

SEQ ID NO: 615 - DNA, 25 bp, Artificial sequence
  Synthetic sequence: Probe suitable for detection of genetic variations associated with known erythrocyte antigens, and useful for genotyping for blood groups
gccagggaggccagcgtggacttca

SEQ ID NO: 616 - DNA, 25 bp, Artificial sequence
  Synthetic sequence: Probe suitable for detection of genetic variations associated with known erythrocyte antigens, and useful for genotyping for blood groups
gccagggaggccggcgtggacttca

SEQ ID NO: 617 - DNA, 23 bp, Artificial sequence
  Synthetic sequence: Probe suitable for detection of genetic variations associated with known erythrocyte antigens, and useful for genotyping for blood groups
ccagggaggccagcgtggacttc

SEQ ID NO: 618 - DNA, 23 bp, Artificial sequence
  Synthetic sequence: Probe suitable for detection of genetic variations associated with known erythrocyte antigens, and useful for genotyping for blood groups
ccagggaggccggcgtggacttc

SEQ ID NO: 619 - DNA, 25 bp, Artificial sequence
  Synthetic sequence: Probe suitable for detection of genetic variations associated with known erythrocyte antigens, and reactions to pharmaceuticals
actgcaaccagtttcctcttgggtg

SEQ ID NO: 620 - DNA, 25 bp, Artificial sequence
  Synthetic sequence: Probe suitable for detection of genetic variations associated with known erythrocyte antigens, and useful for genotyping for blood groups
actgcaaccagtctcctcttgggtg

SEQ ID NO: 621 - DNA, 27 bp, Artificial sequence
  Synthetic sequence: Probe suitable for detection of genetic variations associated with known erythrocyte antigens, and useful for genotyping for blood groups
aactgcaaccagtttcctcttgggtgg

SEQ ID NO: 622 - DNA, 27 bp, Artificial sequence
  Synthetic sequence: Probe suitable for detection of genetic variations associated with known erythrocyte antigens, and useful for genotyping for blood groups
aactgcaaccagtctcctcttgggtgg

SEQ ID NO: 623 - DNA, 25 bp, Artificial sequence
  Synthetic sequence: Probe suitable for detection of genetic variations associated with known erythrocyte antigens, and useful for genotyping for blood groups
ttgtcctggaccgccgtctggttgt

SEQ ID NO: 624 - DNA, 25 bp, Artificial sequence
  Synthetic sequence: Probe suitable for detection of genetic variations associated with known erythrocyte antigens, and useful for genotyping for blood groups
ttgtcctggaccaccgtctggttgt

SEQ ID NO: 625 - DNA, 23 bp, Artificial sequence
  Synthetic sequence: Probe suitable for detection of genetic variations associated with known erythrocyte antigens, and useful for genotyping for blood groups
tgtcctggaccgccgtctggttg

SEQ ID NO: 626 - DNA, 23 bp, Artificial sequence
  Synthetic sequence: Probe suitable for detection of genetic variations associated with known erythrocyte antigens, and useful for genotyping for blood groups
tgtcctggaccaccgtctggttg

SEQ ID NO: 627 - DNA, 21 bp, Artificial sequence
  Synthetic sequence: Probe suitable for detection of genetic variations associated with known erythrocyte antigens, and useful for genotyping for blood groups
gctggtgcttgataccgtcgg

SEQ ID NO: 628 - DNA, 21 bp, Artificial sequence
  Synthetic sequence: Probe suitable for detection of genetic variations associated with known erythrocyte antigens, and useful for genotyping for blood groups
gctggtgcttcataccgtcgg

SEQ ID NO: 629 - DNA, 23 bp, Artificial sequence
  Synthetic sequence: Probe suitable for detection of genetic variations associated with known erythrocyte antigens, and useful for genotyping for blood groups
tgctggtgcttgataccgtcgga

SEQ ID NO: 630 - DNA, 23 bp, Artificial sequence
  Synthetic sequence: Probe suitable for detection of genetic variations associated with known erythrocyte antigens, and useful for genotyping for blood groups
tgctggtgcttcataccgtcgga

SEQ ID NO: 631 - DNA, 25 bp, Artificial sequence
  Synthetic sequence: Probe suitable for detection of genetic variations associated with IBD
tcaccttcccagcaccttctagttc

SEQ ID NO: 632 - DNA, 25 bp, Artificial sequence
  Synthetic sequence: Probe suitable for detection of genetic variations associated with IBD
gaactagaaggtgctgggaaggtga

SEQ ID NO: 633 - DNA, 25 bp, Artificial sequence
  Synthetic sequence: Probe suitable for detection of genetic variations associated with IBD
tcaccttcccaggaccttctagttc

SEQ ID NO: 634 - DNA, 25 bp, Artificial sequence
  Synthetic sequence: Probe suitable for detection of genetic variations associated with IBD
gaactagaaggtcctgggaaggtga

SEQ ID NO: 635 - DNA, 25 bp, Artificial sequence
  Synthetic sequence: Probe suitable for detection of genetic variations associated with IBD
tcaccttcccagaaccttctagttc

SEQ ID NO: 636 - DNA, 25 bp, Artificial sequence
  Synthetic sequence: Probe suitable for detection of genetic variations associated with IBD
gaactagaaggttctgggaaggtga

SEQ ID NO: 637 - DNA, 25 bp, Artificial sequence
  Synthetic sequence: Probe suitable for detection of genetic variations associated with IBD
tcaccttcccagtaccttctagttc

SEQ ID NO: 638 - DNA, 25 bp, Artificial sequence
  Synthetic sequence: Probe suitable for detection of genetic variations associated with IBD
gaactagaaggtactgggaaggtga

SEQ ID NO: 639 - DNA, 25 bp, Artificial sequence
  Synthetic sequence: Probe suitable for detection of genetic variations associated with IBD
tgctgccctcacaatctcttcctgt

SEQ ID NO: 640 - DNA, 25 bp, Artificial sequence
  Synthetic sequence: Probe suitable for detection of genetic variations associated with IBD
acaggaagagattgtgagggcagca

SEQ ID NO: 641 - DNA, 25 bp, Artificial sequence
  Synthetic sequence: Probe suitable for detection of genetic variations associated with IBD
tgctgccctcacgatctcttcctgt

SEQ ID NO: 642 - DNA, 25 bp, Artificial sequence
  Synthetic sequence: Probe suitable for detection of genetic variations associated with IBD
acaggaagagatcgtgagggcagca

SEQ ID NO: 643 - DNA, 25 bp, Artificial sequence
  Synthetic sequence: Probe suitable for detection of genetic variations associated with IBD
aaggccctgctccggcgccaggcct

SEQ ID NO: 644 - DNA, 25 bp, Artificial sequence
  Synthetic sequence: Probe suitable for detection of genetic variations associated with IBD
aggcctggcgccggagcagggcctt

SEQ ID NO: 645 - DNA, 25 bp, Artificial sequence
  Synthetic sequence: Probe suitable for detection of genetic variations associated with IBD
aaggccctgctctggcgccaggcct

SEQ ID NO: 646 - DNA, 25 bp, Artificial sequence
  Synthetic sequence: Probe suitable for detection of genetic variations associated with IBD
aggcctggcgccagagcagggcctt

SEQ ID NO: 647 - DNA, 25 bp, Artificial sequence
  Synthetic sequence: Probe suitable for detection of genetic variations associated with IBD
ttcagattctggggcaacagagtgg

SEQ ID NO: 648 - DNA, 25 bp, Artificial sequence
  Synthetic sequence: Probe suitable for detection of genetic variations associated with IBD
ccactctgttgccccagaatctgaa

SEQ ID NO: 649 - DNA, 25 bp, Artificial sequence
  Synthetic sequence: Probe suitable for detection of genetic variations associated with IBD
ttcagattctggcgcaacagagtgg

SEQ ID NO: 650 - DNA, 25 bp, Artificial sequence
  Synthetic sequence: Probe suitable for detection of genetic variations associated with IBD
ccactctgttgcgccagaatctgaa

SEQ ID NO: 651 - DNA, 25 bp, Artificial sequence
  Synthetic sequence: Probe suitable for detection of genetic variations associated with IBD
tcctgcaggccccttgaaaggaatg

SEQ ID NO: 652 - DNA, 25 bp, Artificial sequence
  Synthetic sequence: Probe suitable for detection of genetic variations associated with IBD
cattcctttcaaggggcctgcagga

SEQ ID NO: 653 - DNA, 25 bp, Artificial sequence
  Synthetic sequence: Probe suitable for detection of genetic variations associated with IBD
tcctgcaggcccttgaaaggaatga

SEQ ID NO: 654 - DNA, 25 bp, Artificial sequence
  Synthetic sequence: Probe suitable for detection of genetic variations associated with IBD
tcattcctttcaagggcctgcagga

SEQ ID NO: 655 - DNA, 25 bp, Artificial sequence
  Synthetic sequence: Probe suitable for detection of genetic variations associated with IBD
attctcaacagataccctcacttca

SEQ ID NO: 656 - DNA, 25 bp, Artificial sequence
  Synthetic sequence: Probe suitable for detection of genetic variations associated with IBD
tgaagtgagggtatctgttgagaat

SEQ ID NO: 657 - DNA, 25 bp, Artificial sequence
  Synthetic sequence: Probe suitable for detection of genetic variations associated with IBD
attctcaacagacaccctcacttca

SEQ ID NO: 658 - DNA, 25 bp, Artificial sequence
  Synthetic sequence: Probe suitable for detection of genetic variations associated with IBD
tgaagtgagggtgtctgttgagaat

SEQ ID NO: 659 - DNA, 25 bp, Artificial sequence
  Synthetic sequence: Probe suitable for detection of genetic variations associated with IBD
aggcagacagctgtcactttccaga

SEQ ID NO: 660 - DNA, 25 bp, Artificial sequence
  Synthetic sequence: Probe suitable for detection of genetic variations associated with IBD
tctggaaagtgacagctgtctgcct

SEQ ID NO: 661 - DNA, 25 bp, Artificial sequence
  Synthetic sequence: Probe suitable for detection of genetic variations associated with IBD
aggcagacagctatcactttccaga

SEQ ID NO: 662 - DNA, 25 bp, Artificial sequence
  Synthetic sequence: Probe suitable for detection of genetic variations associated with IBD
tctggaaagtgatagctgtctgcct

SEQ ID NO: 663 - DNA, 25 bp, Artificial sequence
  Synthetic sequence: Probe suitable for detection of genetic variations associated with IBD
gcttctttgggaaggggaagtaggg

SEQ ID NO: 664 - DNA, 25 bp, Artificial sequence
  Synthetic sequence: Probe suitable for detection of genetic variations associated with IBD
ccctacttccccttcccaaagaagc

SEQ ID NO: 665 - DNA, 25 bp, Artificial sequence
  Synthetic sequence: Probe suitable for detection of genetic variations associated with IBD
gcttctttgggagggggaagtaggg

SEQ ID NO: 666 - DNA, 25 bp, Artificial sequence
  Synthetic sequence: Probe suitable for detection of genetic variations associated with IBD
ccctacttccccctcccaaagaagc

SEQ ID NO: 667 - DNA, 25 bp, Artificial sequence
  Synthetic sequence: Probe suitable for detection of genetic variations associated with IBD
gtcctcctgactggggtgagggcca

SEQ ID NO: 668 - DNA, 25 bp, Artificial sequence
  Synthetic sequence: Probe suitable for detection of genetic variations associated with IBD
gtcctcctgactagggtgagggcca

SEQ ID NO: 669 - DNA, 25 bp, Artificial sequence
  Synthetic sequence: Probe suitable for detection of genetic variations associated with IBD
tggccctcaccccagtcaggaggac

SEQ ID NO: 670 - DNA, 25 bp, Artificial sequence
  Synthetic sequence: Probe suitable for detection of genetic variations associated with IBD
tggccctcaccctagtcaggaggac

SEQ ID NO: 671 - DNA, 25 bp, Artificial sequence
  Synthetic sequence: Probe suitable for detection of genetic variations associated with IBD
ttgttcctatcataaagagtcaggg

SEQ ID NO: 672 - DNA, 25 bp, Artificial sequence
  Synthetic sequence: Probe suitable for detection of genetic variations associated with IBD
ccctgactctttatgataggaacaa

SEQ ID NO: 673 - DNA, 25 bp, Artificial sequence
  Synthetic sequence: Probe suitable for detection of genetic variations associated with IBD
ttgttcctatcacaaagagtcaggg

SEQ ID NO: 674 - DNA, 25 bp, Artificial sequence
  Synthetic sequence: Probe suitable for detection of genetic variations associated with IBD
ccctgactctttgtgataggaacaa

SEQ ID NO: 675 - DNA, 25 bp, Artificial sequence
  Synthetic sequence: Probe suitable for detection of genetic variations associated with IBD
atgaaaacattgtgaaatacaaagc

SEQ ID NO: 676 - DNA, 25 bp, Artificial sequence
  Synthetic sequence: Probe suitable for detection of genetic variations associated with IBD
gctttgtatttcacaatgttttcat

SEQ ID NO: 677 - DNA, 25 bp, Artificial sequence
  Synthetic sequence: Probe suitable for detection of genetic variations associated with IBD
atgaaaacattgcgaaatacaaagc

SEQ ID NO: 678 - DNA, 25 bp, Artificial sequence
  Synthetic sequence: Probe suitable for detection of genetic variations associated with IBD
gctttgtatttcgcaatgttttcat

SEQ ID NO: 679 - DNA, 25 bp, Artificial sequence
  Synthetic sequence: Probe suitable for detection of genetic variations associated with IBD
ccccgaccattgggcccggcaggcg

SEQ ID NO: 680 - DNA, 25 bp, Artificial sequence
  Synthetic sequence: Probe suitable for detection of genetic variations associated with IBD
cgcctgccgggcccaatggtcgggg

SEQ ID NO: 681 - DNA, 25 bp, Artificial sequence
  Synthetic sequence: Probe suitable for detection of genetic variations associated with IBD
ccccgaccattgattgggcccggca

SEQ ID NO: 682 - DNA, 25 bp, Artificial sequence
  Synthetic sequence: Probe suitable for detection of genetic variations associated with IBD
tgccgggcccaatcaatggtcgggg

SEQ ID NO: 683 - DNA, 25 bp, Artificial sequence
  Synthetic sequence: Probe suitable for detection of genetic variations associated with IBD
tgcacactgcctggcccaaaacgtc

SEQ ID NO: 684 - DNA, 25 bp, Artificial sequence
  Synthetic sequence: Probe suitable for detection of genetic variations associated with IBD
tgcacactgcctagcccaaaacgtc

SEQ ID NO: 685 - DNA, 25 bp, Artificial sequence
  Synthetic sequence: Probe suitable for detection of genetic variations associated with IBD
gacgttttgggccaggcagtgtgca

SEQ ID NO: 686 - DNA, 25 bp, Artificial sequence
  Synthetic sequence: Probe suitable for detection of genetic variations associated with IBD
gacgttttgggctaggcagtgtgca

SEQ ID NO: 687 - DNA, 25 bp, Artificial sequence
  Synthetic sequence: Probe suitable for detection of genetic variations associated with IBD
gctctgagacacgccccaacatgcc

SEQ ID NO: 688 - DNA, 25 bp, Artificial sequence
  Synthetic sequence: Probe suitable for detection of genetic variations associated with IBD
ggcatgttggggcgtgtctcagagc

SEQ ID NO: 689 - DNA, 25 bp, Artificial sequence
  Synthetic sequence: Probe suitable for detection of genetic variations associated with IBD
gctctgagacacaccccaacatgcc

SEQ ID NO: 690 - DNA, 25 bp, Artificial sequence
  Synthetic sequence: Probe suitable for detection of genetic variations associated with IBD
ggcatgttggggtgtgtctcagagc

SEQ ID NO: 691 - DNA, 25 bp, Artificial sequence
  Synthetic sequence: Probe suitable for detection of genetic variations associated with IBD
gccaaagtaatcggattccaggttt

SEQ ID NO: 692 - DNA, 25 bp, Artificial sequence
  Synthetic sequence: Probe suitable for detection of genetic variations associated with IBD
aaacctggaatccgattactttggc

SEQ ID NO: 693 - DNA, 25 bp, Artificial sequence
  Synthetic sequence: Probe suitable for detection of genetic variations associated with IBD
gccaaagtaatctgattccaggttt

SEQ ID NO: 694 - DNA, 25 bp, Artificial sequence
  Synthetic sequence: Probe suitable for detection of genetic variations associated with IBD
aaacctggaatcagattactttggc

SEQ ID NO: 695 - DNA, 25 bp, Artificial sequence
  Synthetic sequence: Probe suitable for detection of genetic variations associated with IBD
ctacttcctggagcagcaagagcat

SEQ ID NO: 696 - DNA, 25 bp, Artificial sequence
  Synthetic sequence: Probe suitable for detection of genetic variations associated with IBD
atgctcttgctgctccaggaagtag

SEQ ID NO: 697 - DNA, 25 bp, Artificial sequence
  Synthetic sequence: Probe suitable for detection of genetic variations associated with IBD
ctacttcctggaacagcaagagcat

SEQ ID NO: 698 - DNA, 25 bp, Artificial sequence
  Synthetic sequence: Probe suitable for detection of genetic variations associated with IBD
atgctcttgctgttccaggaagtag

SEQ ID NO: 699 - DNA, 25 bp, Artificial sequence
  Synthetic sequence: Probe suitable for detection of genetic variations associated with IBD
cctggagcagcaggagcatttcttt

SEQ ID NO: 700 - DNA, 25 bp, Artificial sequence
  Synthetic sequence: Probe suitable for detection of genetic variations associated with IBD
aaagaaatgctcctgctgctccagg

SEQ ID NO: 701 - DNA, 25 bp, Artificial sequence
  Synthetic sequence: Probe suitable for detection of genetic variations associated with IBD
cctggagcagcaagagcatttcttt

SEQ ID NO: 702 - DNA, 25 bp, Artificial sequence
  Synthetic sequence: Probe suitable for detection of genetic variations associated with IBD
aaagaaatgctcttgctgctccagg

SEQ ID NO: 703 - DNA, 25 bp, Artificial sequence
  Synthetic sequence: Probe suitable for detection of genetic variations associated with IBD
cgccctgctcgacgcgctgattggg

SEQ ID NO: 704 - DNA, 25 bp, Artificial sequence
  Synthetic sequence: Probe suitable for detection of genetic variations associated with IBD
cccaatcagcgcgtcgagcagggcg

SEQ ID NO: 705 - DNA, 25 bp, Artificial sequence
  Synthetic sequence: Probe suitable for detection of genetic variations associated with IBD
cgccctgctcgatgcgctgattggg

SEQ ID NO: 706 - DNA, 25 bp, Artificial sequence
  Synthetic sequence: Probe suitable for detection of genetic variations associated with IBD
cccaatcagcgcatcgagcagggcg

SEQ ID NO: 707 - DNA, 25 bp, Artificial sequence
  Synthetic sequence: Probe suitable for detection of genetic variations associated with IBD
gccaatcagctccggaactacggag

SEQ ID NO: 708 - DNA, 25 bp, Artificial sequence
  Synthetic sequence: Probe suitable for detection of genetic variations associated with IBD
ctccgtagttccggagctgattggc

SEQ ID NO: 709 - DNA, 25 bp, Artificial sequence
  Synthetic sequence: Probe suitable for detection of genetic variations associated with IBD
gccaatcagctctggaactacggag

SEQ ID NO: 710 - DNA, 25 bp, Artificial sequence
  Synthetic sequence: Probe suitable for detection of genetic variations associated with IBD
ctccgtagttccagagctgattggc

SEQ ID NO: 711 - DNA, 25 bp, Artificial sequence
  Synthetic sequence: Probe suitable for detection of genetic variations associated with IBD
tcattcacttgccggtcagtgagga

SEQ ID NO: 712 - DNA, 25 bp, Artificial sequence
  Synthetic sequence: Probe suitable for detection of genetic variations associated with IBD
tcctcactgaccggcaagtgaatga

SEQ ID NO: 713 - DNA, 25 bp, Artificial sequence
  Synthetic sequence: Probe suitable for detection of genetic variations associated with IBD
tcattcacttgctggtcagtgagga

SEQ ID NO: 714 - DNA, 25 bp, Artificial sequence
  Synthetic sequence: Probe suitable for detection of genetic variations associated with IBD
tcctcactgaccagcaagtgaatga

SEQ ID NO: 715 - DNA, 25 bp, Artificial sequence
  Synthetic sequence: Probe suitable for detection of genetic variations associated with IBD
aaacccttattcacctaatcacagc

SEQ ID NO: 716 - DNA, 25 bp, Artificial sequence
  Synthetic sequence: Probe suitable for detection of genetic variations associated with IBD
gctgtgattaggtgaataagggttt

SEQ ID NO: 717 - DNA, 25 bp, Artificial sequence
  Synthetic sequence: Probe suitable for detection of genetic variations associated with IBD
aaacccttattctcctaatcacagc

SEQ ID NO: 718 - DNA, 25 bp, Artificial sequence
  Synthetic sequence: Probe suitable for detection of genetic variations associated with IBD
gctgtgattaggagaataagggttt

SEQ ID NO: 719 - DNA, 25 bp, Artificial sequence
  Synthetic sequence: Probe suitable for detection of genetic variations associated with IBD
ctgattggaatcctcaccctttttt

SEQ ID NO: 720 - DNA, 25 bp, Artificial sequence
  Synthetic sequence: Probe suitable for detection of genetic variations associated with IBD
aaaaaagggtgaggattccaatcag

SEQ ID NO: 721 - DNA, 25 bp, Artificial sequence
  Synthetic sequence: Probe suitable for detection of genetic variations associated with IBD
ctgattggaatcttcaccctttttt

SEQ ID NO: 722 - DNA, 25 bp, Artificial sequence
  Synthetic sequence: Probe suitable for detection of genetic variations associated with IBD
aaaaaagggtgaagattccaatcag

SEQ ID NO: 723 - DNA, 25 bp, Artificial sequence
  Synthetic sequence: Probe suitable for detection of genetic variations associated with IBD
ccagggaaggttgcgggcctgggcc

SEQ ID NO: 724 - DNA, 25 bp, Artificial sequence
  Synthetic sequence: Probe suitable for detection of genetic variations associated with IBD
ggcccaggcccgcaaccttccctgg

SEQ ID NO: 725 - DNA, 25 bp, Artificial sequence
  Synthetic sequence: Probe suitable for detection of genetic variations associated with IBD
ccagggaaggttccgggcctgggcc

SEQ ID NO: 726 - DNA, 25 bp, Artificial sequence
  Synthetic sequence: Probe suitable for detection of genetic variations associated with IBD
ggcccaggcccggaaccttccctgg

SEQ ID NO: 727 - DNA, 25 bp, Artificial sequence
  Synthetic sequence: Probe suitable for detection of genetic variations associated with IBD
actacctcgatgatattattgactt

SEQ ID NO: 728 - DNA, 25 bp, Artificial sequence
  Synthetic sequence: Probe suitable for detection of genetic variations associated with IBD
aagtcaataatatcatcgaggtagt

SEQ ID NO: 729 - DNA, 25 bp, Artificial sequence
  Synthetic sequence: Probe suitable for detection of genetic variations associated with IBD
actacctcgatggtattattgactt

SEQ ID NO: 730 - DNA, 25 bp, Artificial sequence
  Synthetic sequence: Probe suitable for detection of genetic variations associated with IBD
aagtcaataataccatcgaggtagt

SEQ ID NO: 731 - DNA, 25 bp, Artificial sequence
  Synthetic sequence: Probe suitable for detection of genetic variations associated with IBD
attttgggacaaccagcctaaagta

SEQ ID NO: 732 - DNA, 25 bp, Artificial sequence
  Synthetic sequence: Probe suitable for detection of genetic variations associated with IBD
tactttaggctggttgtcccaaaat

SEQ ID NO: 733 - DNA, 25 bp, Artificial sequence
  Synthetic sequence: Probe suitable for detection of genetic variations associated with IBD
attttgggacaatcagcctaaagta

SEQ ID NO: 734 - DNA, 25 bp, Artificial sequence
  Synthetic sequence: Probe suitable for detection of genetic variations associated with IBD
tactttaggctgattgtcccaaaat

SEQ ID NO: 735 - DNA, 25 bp, Artificial sequence
  Synthetic sequence: Probe suitable for detection of genetic variations associated with IBD
gaagagaatcccagagcagcctgtt

SEQ ID NO: 736 - DNA, 25 bp, Artificial sequence
  Synthetic sequence: Probe suitable for detection of genetic variations associated with IBD
aacaggctgctctgggattctcttc

SEQ ID NO: 737 - DNA, 25 bp, Artificial sequence
  Synthetic sequence: Probe suitable for detection of genetic variations associated with IBD
gaagagaatccccgagcagcctgtt

SEQ ID NO: 738 - DNA, 25 bp, Artificial sequence
  Synthetic sequence: Probe suitable for detection of genetic variations associated with IBD
aacaggctgctcggggattctcttc

SEQ ID NO: 739 - DNA, 25 bp, Artificial sequence
  Synthetic sequence: Probe suitable for detection of genetic variations associated with IBD
agctggctccggctttggggtatct

SEQ ID NO: 740 - DNA, 25 bp, Artificial sequence
  Synthetic sequence: Probe suitable for detection of genetic variations associated with IBD
agataccccaaagccggagccagct

SEQ ID NO: 741 - DNA, 25 bp, Artificial sequence
  Synthetic sequence: Probe suitable for detection of genetic variations associated with IBD
agctggctccggttttggggtatct

SEQ ID NO: 742 - DNA, 25 bp, Artificial sequence
  Synthetic sequence: Probe suitable for detection of genetic variations associated with IBD
agataccccaaaaccggagccagct

SEQ ID NO: 743 - DNA, 25 bp, Artificial sequence
  Synthetic sequence: Probe suitable for detection of genetic variations associated with IBD
tctcctattgacccagaaagcgatt

SEQ ID NO: 744 - DNA, 25 bp, Artificial sequence
  Synthetic sequence: Probe suitable for detection of genetic variations associated with IBD
aatcgctttctgggtcaataggaga

SEQ ID NO: 745 - DNA, 25 bp, Artificial sequence
  Synthetic sequence: Probe suitable for detection of genetic variations associated with IBD
tctcctattgacgcagaaagcgatt

SEQ ID NO: 746 - DNA, 25 bp, Artificial sequence
  Synthetic sequence: Probe suitable for detection of genetic variations associated with IBD
aatcgctttctgcgtcaataggaga

SEQ ID NO: 747 - DNA, 25 bp, Artificial sequence
  Synthetic sequence: Probe suitable for detection of genetic variations associated with IBD
gaggtcacccgcaaggtgaccgtga

SEQ ID NO: 748 - DNA, 25 bp, Artificial sequence
  Synthetic sequence: Probe suitable for detection of genetic variations associated with IBD
tcacggtcaccttgcgggtgacctc

SEQ ID NO: 749 - DNA, 25 bp, Artificial sequence
  Synthetic sequence: Probe suitable for detection of genetic variations associated with IBD
gaggtcacccgcgaggtgaccgtga

SEQ ID NO: 750 - DNA, 25 bp, Artificial sequence
  Synthetic sequence: Probe suitable for detection of genetic variations associated with IBD
tcacggtcacctcgcgggtgacctc

SEQ ID NO: 751 - DNA, 25 bp, Artificial sequence
  Synthetic sequence: Probe suitable for detection of genetic variations associated with IBD
tgttccctggacaggctgttcccag

SEQ ID NO: 752 - DNA, 25 bp, Artificial sequence
  Synthetic sequence: Probe suitable for detection of genetic variations associated with IBD
ctgggaacagcctgtccagggaaca

SEQ ID NO: 753 - DNA, 25 bp, Artificial sequence
  Synthetic sequence: Probe suitable for detection of genetic variations associated with IBD
tgttccctggacgggctgttcccag

SEQ ID NO: 754 - DNA, 25 bp, Artificial sequence
  Synthetic sequence: Probe suitable for detection of genetic variations associated with IBD
ctgggaacagcccgtccagggaaca

SEQ ID NO: 755 - DNA, 25 bp, Artificial sequence
  Synthetic sequence: Probe suitable for detection of genetic variations associated with IBD
ccttgcaaccctggcaaaggtaatg

SEQ ID NO: 756 - DNA, 25 bp, Artificial sequence
  Synthetic sequence: Probe suitable for detection of genetic variations associated with IBD
cattacctttgccagggttgcaagg

SEQ ID NO: 757 - DNA, 25 bp, Artificial sequence
  Synthetic sequence: Probe suitable for detection of genetic variations associated with IBD
ccttgcaaccctcgcaaaggtaatg

SEQ ID NO: 758 - DNA, 25 bp, Artificial sequence
  Synthetic sequence: Probe suitable for detection of genetic variations associated with IBD
cattacctttgcgagggttgcaagg

SEQ ID NO: 759 - DNA, 25 bp, Artificial sequence
  Synthetic sequence: Probe suitable for detection of genetic variations associated with IBD
cagtagacgaacgatgcaaaatacc

SEQ ID NO: 760 - DNA, 25 bp, Artificial sequence
  Synthetic sequence: Probe suitable for detection of genetic variations associated with IBD
ggtattttgcatcgttcgtctactg

SEQ ID NO: 761 - DNA, 25 bp, Artificial sequence
  Synthetic sequence: Probe suitable for detection of genetic variations associated with IBD
cagtagacgaaccatgcaaaatacc

SEQ ID NO: 762 - DNA, 25 bp, Artificial sequence
  Synthetic sequence: Probe suitable for detection of genetic variations associated with IBD
ggtattttgcatggttcgtctactg

SEQ ID NO: 763 - DNA, 25 bp, Artificial sequence
  Synthetic sequence: Probe suitable for detection of genetic variations associated with IBD
catcctggagaatagctgagaacct

SEQ ID NO: 764 - DNA, 25 bp, Artificial sequence
  Synthetic sequence: Probe suitable for detection of genetic variations associated with IBD
aggttctcagctattctccaggatg

SEQ ID NO: 765 - DNA, 25 bp, Artificial sequence
  Synthetic sequence: Probe suitable for detection of genetic variations associated with IBD
catcctggagaacagctgagaacct

SEQ ID NO: 766 - DNA, 25 bp, Artificial sequence
  Synthetic sequence: Probe suitable for detection of genetic variations associated with IBD
aggttctcagctgttctccaggatg

SEQ ID NO: 767 - DNA, 25 bp, Artificial sequence
  Synthetic sequence: Probe suitable for detection of genetic variations associated with IBD
gaagctgctgcaagacttcttcaac

SEQ ID NO: 768 - DNA, 25 bp, Artificial sequence
  Synthetic sequence: Probe suitable for detection of genetic variations associated with IBD
gttgaagaagtcttgcagcagcttc

SEQ ID NO: 769 - DNA, 25 bp, Artificial sequence
  Synthetic sequence: Probe suitable for detection of genetic variations associated with IBD
gaagctgctgcaggacttcttcaac

SEQ ID NO: 770 - DNA, 25 bp, Artificial sequence
  Synthetic sequence: Probe suitable for detection of genetic variations associated with IBD
gttgaagaagtcctgcagcagcttc

SEQ ID NO: 771 - DNA, 25 bp, Artificial sequence
  Synthetic sequence: Probe suitable for detection of genetic variations associated with IBD
tccctctgcctgaaaactcccccaa

SEQ ID NO: 772 - DNA, 25 bp, Artificial sequence
  Synthetic sequence: Probe suitable for detection of genetic variations associated with IBD
ttgggggagttttcaggcagaggga

SEQ ID NO: 773 - DNA, 25 bp, Artificial sequence
  Synthetic sequence: Probe suitable for detection of genetic variations associated with IBD
tccctctgcctggaaactcccccaa

SEQ ID NO: 774 - DNA, 25 bp, Artificial sequence
  Synthetic sequence: Probe suitable for detection of genetic variations associated with IBD
ttgggggagtttccaggcagaggga

SEQ ID NO: 775 - DNA, 25 bp, Artificial sequence
  Synthetic sequence: Probe suitable for detection of genetic variations associated with IBD
tgtctgcgggagccgatttcatcat

SEQ ID NO: 776 - DNA, 25 bp, Artificial sequence
  Synthetic sequence: Probe suitable for detection of genetic variations associated with IBD
atgatgaaatcggctcccgcagaca

SEQ ID NO: 777 - DNA, 25 bp, Artificial sequence
  Synthetic sequence: Probe suitable for detection of genetic variations associated with IBD
tgtctgcgggagtcgatttcatcat

SEQ ID NO: 778 - DNA, 25 bp, Artificial sequence
  Synthetic sequence: Probe suitable for detection of genetic variations associated with IBD
atgatgaaatcgactcccgcagaca

SEQ ID NO: 779 - DNA, 25 bp, Artificial sequence
  Synthetic sequence: Probe suitable for detection of genetic variations associated with IBD
ggagaacattgtcccccagtgctgg

SEQ ID NO: 780 - DNA, 25 bp, Artificial sequence
  Synthetic sequence: Probe suitable for detection of genetic variations associated with IBD
ccagcactgggggacaatgttctcc

SEQ ID NO: 781 - DNA, 25 bp, Artificial sequence
  Synthetic sequence: Probe suitable for detection of genetic variations associated with IBD
ggagaacattgttccccagtgctgg

SEQ ID NO: 782 - DNA, 25 bp, Artificial sequence
  Synthetic sequence: Probe suitable for detection of genetic variations associated with IBD
ccagcactggggaacaatgttctcc

SEQ ID NO: 783 - DNA, 25 bp, Artificial sequence
  Synthetic sequence: Probe suitable for detection of genetic variations associated with IBD
ataaactaattgcctcacattgtca

SEQ ID NO: 784 - DNA, 25 bp, Artificial sequence
  Synthetic sequence: Probe suitable for detection of genetic variations associated with IBD
tgacaatgtgaggcaattagtttat

SEQ ID NO: 785 - DNA, 25 bp, Artificial sequence
  Synthetic sequence: Probe suitable for detection of genetic variations associated with IBD
ataaactaattgtctcacattgtca

SEQ ID NO: 786 - DNA, 25 bp, Artificial sequence
  Synthetic sequence: Probe suitable for detection of genetic variations associated with IBD
tgacaatgtgagacaattagtttat

SEQ ID NO: 787 - DNA, 25 bp, Artificial sequence
  Synthetic sequence: Probe suitable for detection of genetic variations associated with IBD
atgggcgtgatgacaccaagggaga

SEQ ID NO: 788 - DNA, 25 bp, Artificial sequence
  Synthetic sequence: Probe suitable for detection of genetic variations associated with IBD
tctcccttggtgtcatcacgcccat

SEQ ID NO: 789 - DNA, 25 bp, Artificial sequence
  Synthetic sequence: Probe suitable for detection of genetic variations associated with IBD
atgggcgtgatggcaccaagggaga

SEQ ID NO: 790 - DNA, 25 bp, Artificial sequence
  Synthetic sequence: Probe suitable for detection of genetic variations associated with IBD
tctcccttggtgccatcacgcccat

SEQ ID NO: 791 - DNA, 25 bp, Artificial sequence
  Synthetic sequence: Probe suitable for detection of genetic variations associated with IBD
atggcaccaaggaagaaaaggggga

SEQ ID NO: 792 - DNA, 25 bp, Artificial sequence
  Synthetic sequence: Probe suitable for detection of genetic variations associated with IBD
tcccccttttcttccttggtgccat

SEQ ID NO: 793 - DNA, 25 bp, Artificial sequence
  Synthetic sequence: Probe suitable for detection of genetic variations associated with IBD
atggcaccaagggagaaaaggggga

SEQ ID NO: 794 - DNA, 25 bp, Artificial sequence
  Synthetic sequence: Probe suitable for detection of genetic variations associated with IBD
tcccccttttctcccttggtgccat

SEQ ID NO: 795 - DNA, 25 bp, Artificial sequence
  Synthetic sequence: Probe suitable for detection of genetic variations associated with IBD
ggcaaagatgggcgtgatggcacca

SEQ ID NO: 796 - DNA, 25 bp, Artificial sequence
  Synthetic sequence: Probe suitable for detection of genetic variations associated with IBD
tggtgccatcacgcccatctttgcc

SEQ ID NO: 797 - DNA, 25 bp, Artificial sequence
  Synthetic sequence: Probe suitable for detection of genetic variations associated with IBD
ggcaaagatgggtgtgatggcacca

SEQ ID NO: 798 - DNA, 25 bp, Artificial sequence
  Synthetic sequence: Probe suitable for detection of genetic variations associated with IBD
tggtgccatcacacccatctttgcc

SEQ ID NO: 799 - DNA, 25 bp, Artificial sequence
  Synthetic sequence: Probe suitable for detection of genetic variations associated with IBD
cgtgacccggccaggggaagaagct

SEQ ID NO: 800 - DNA, 25 bp, Artificial sequence
  Synthetic sequence: Probe suitable for detection of genetic variations associated with IBD
cgtgacccggccgggggaagaagct

SEQ ID NO: 801 - DNA, 25 bp, Artificial sequence
  Synthetic sequence: Probe suitable for detection of genetic variations associated with IBD
agcttcttcccctggccgggtcacg

SEQ ID NO: 802 - DNA, 25 bp, Artificial sequence
  Synthetic sequence: Probe suitable for detection of genetic variations associated with IBD
agcttcttcccccggccgggtcacg

SEQ ID NO: 803 - DNA, 25 bp, Artificial sequence
  Synthetic sequence: Probe suitable for detection of genetic variations associated with IBD
ggacacgtgggggagtcagccgtgt

SEQ ID NO: 804 - DNA, 25 bp, Artificial sequence
  Synthetic sequence: Probe suitable for detection of genetic variations associated with IBD
acacggctgactcccccacgtgtcc

SEQ ID NO: 805 - DNA, 25 bp, Artificial sequence
  Synthetic sequence: Probe suitable for detection of genetic variations associated with IBD
ggacacgtggggagtcagccgtgta

SEQ ID NO: 806 - DNA, 25 bp, Artificial sequence
  Synthetic sequence: Probe suitable for detection of genetic variations associated with IBD
tacacggctgactccccacgtgtcc

SEQ ID NO: 807 - DNA, 25 bp, Artificial sequence
  Synthetic sequence: Probe suitable for detection of genetic variations associated with IBD
ccccccccttaacgaagacagggcc

SEQ ID NO: 808 - DNA, 25 bp, Artificial sequence
  Synthetic sequence: Probe suitable for detection of genetic variations associated with IBD
ggccctgtcttcgttaagggggggg

SEQ ID NO: 809 - DNA, 25 bp, Artificial sequence
  Synthetic sequence: Probe suitable for detection of genetic variations associated with IBD
ccccccccttaatgaagacagggcc

SEQ ID NO: 810 - DNA, 25 bp, Artificial sequence
  Synthetic sequence: Probe suitable for detection of genetic variations associated with IBD
ggccctgtcttcattaagggggggg

SEQ ID NO: 811 - DNA, 25 bp, Artificial sequence
  Synthetic sequence: Probe suitable for detection of genetic variations associated with IBD
ttgaggggcatggggacggggttca

SEQ ID NO: 812 - DNA, 25 bp, Artificial sequence
  Synthetic sequence: Probe suitable for detection of genetic variations associated with IBD
tgaaccccgtccccatgcccctcaa

SEQ ID NO: 813 - DNA, 25 bp, Artificial sequence
  Synthetic sequence: Probe suitable for detection of genetic variations associated with IBD
ttgaggggcatgaggacggggttca

SEQ ID NO: 814 - DNA, 25 bp, Artificial sequence
  Synthetic sequence: Probe suitable for detection of genetic variations associated with IBD
tgaaccccgtcctcatgcccctcaa

SEQ ID NO: 815 - DNA, 25 bp, Artificial sequence
  Synthetic sequence: Probe suitable for detection of genetic variations associated with IBD
cccctcggaatcggagcagggagga

SEQ ID NO: 816 - DNA, 25 bp, Artificial sequence
  Synthetic sequence: Probe suitable for detection of genetic variations associated with IBD
tcctccctgctccgattccgagggg

SEQ ID NO: 817 - DNA, 25 bp, Artificial sequence
  Synthetic sequence: Probe suitable for detection of genetic variations associated with IBD
cccctcggaatcagagcagggagga

SEQ ID NO: 818 - DNA, 25 bp, Artificial sequence
  Synthetic sequence: Probe suitable for detection of genetic variations associated with IBD
tcctccctgctctgattccgagggg

SEQ ID NO: 819 - DNA, 25 bp, Artificial sequence
  Synthetic sequence: Probe suitable for detection of genetic variations associated with IBD
gtccccggtctgcaaacctgcataa

SEQ ID NO: 820 - DNA, 25 bp, Artificial sequence
  Synthetic sequence: Probe suitable for detection of genetic variations associated with IBD
ttatgcaggtttgcagaccggggac

SEQ ID NO: 821 - DNA, 25 bp, Artificial sequence
  Synthetic sequence: Probe suitable for detection of genetic variations associated with IBD
gtccccggtctggaaacctgcataa

SEQ ID NO: 822 - DNA, 25 bp, Artificial sequence
  Synthetic sequence: Probe suitable for detection of genetic variations associated with IBD
ttatgcaggtttccagaccggggac

SEQ ID NO: 823 - DNA, 25 bp, Artificial sequence
  Synthetic sequence: Probe suitable for detection of genetic variations associated with IBD
tgggatagaggagcattagttgcca

SEQ ID NO: 824 - DNA, 25 bp, Artificial sequence
  Synthetic sequence: Probe suitable for detection of genetic variations associated with IBD
tgggatagaggaacattagttgcca

SEQ ID NO: 825 - DNA, 25 bp, Artificial sequence
  Synthetic sequence: Probe suitable for detection of genetic variations associated with IBD
tggcaactaatgctcctctatccca

SEQ ID NO: 826 - DNA, 25 bp, Artificial sequence
  Synthetic sequence: Probe suitable for detection of genetic variations associated with IBD
tggcaactaatgttcctctatccca

SEQ ID NO: 827 - DNA, 25 bp, Artificial sequence
  Synthetic sequence: Probe suitable for detection of genetic variations associated with IBD
tctgtaagtagatataacttttcaa

SEQ ID NO: 828 - DNA, 25 bp, Artificial sequence
  Synthetic sequence: Probe suitable for detection of genetic variations associated with IBD
ttgaaaagttatatctacttacaga

SEQ ID NO: 829 - DNA, 25 bp, Artificial sequence
  Synthetic sequence: Probe suitable for detection of genetic variations associated with IBD
tctgtaagtagacataacttttcaa

SEQ ID NO: 830 - DNA, 25 bp, Artificial sequence
  Synthetic sequence: Probe suitable for detection of genetic variations associated with IBD
ttgaaaagttatgtctacttacaga

SEQ ID NO: 831 - DNA, 25 bp, Artificial sequence
  Synthetic sequence: Probe suitable for detection of genetic variations associated with IBD
acggtgctgtcctgggatggatctg

SEQ ID NO: 832 - DNA, 25 bp, Artificial sequence
  Synthetic sequence: Probe suitable for detection of genetic variations associated with IBD
acggtgctgtccggggatggatctg

SEQ ID NO: 833 - DNA, 25 bp, Artificial sequence
  Synthetic sequence: Probe suitable for detection of genetic variations associated with IBD
cagatccatcccaggacagcaccgt

SEQ ID NO: 834 - DNA, 25 bp, Artificial sequence
  Synthetic sequence: Probe suitable for detection of genetic variations associated with IBD
cagatccatccccggacagcaccgt

SEQ ID NO: 835 - DNA, 25 bp, Artificial sequence
  Synthetic sequence: Probe suitable for detection of genetic variations associated with IBD
tcagggtttctcgctgaggtacatc

SEQ ID NO: 836 - DNA, 25 bp, Artificial sequence
  Synthetic sequence: Probe suitable for detection of genetic variations associated with IBD
tcagggtttctcactgaggtacatc

SEQ ID NO: 837 - DNA, 25 bp, Artificial sequence
  Synthetic sequence: Probe suitable for detection of genetic variations associated with IBD
gatgtacctcagcgagaaaccctga

SEQ ID NO: 838 - DNA, 25 bp, Artificial sequence
  Synthetic sequence: Probe suitable for detection of genetic variations associated with IBD
gatgtacctcagtgagaaaccctga

SEQ ID NO: 839 - DNA, 25 bp, Artificial sequence
  Synthetic sequence: Probe suitable for detection of genetic variations associated with IBD
gaggaatggacaatgccccagtcct

SEQ ID NO: 840 - DNA, 25 bp, Artificial sequence
  Synthetic sequence: Probe suitable for detection of genetic variations associated with IBD
gaggaatggacagtgccccagtcct

SEQ ID NO: 841 - DNA, 25 bp, Artificial sequence
  Synthetic sequence: Probe suitable for detection of genetic variations associated with IBD
aggactggggcattgtccattcctc

SEQ ID NO: 842 - DNA, 25 bp, Artificial sequence
  Synthetic sequence: Probe suitable for detection of genetic variations associated with IBD
aggactggggcactgtccattcctc

SEQ ID NO: 843 - DNA, 25 bp, Artificial sequence
  Synthetic sequence: Probe suitable for detection of genetic variations associated with IBD
cggcgatatctaaaatccggcgtag

SEQ ID NO: 844 - DNA, 25 bp, Artificial sequence
  Synthetic sequence: Probe suitable for detection of genetic variations associated with IBD
cggcgatatctagaatccggcgtag

SEQ ID NO: 845 - DNA, 25 bp, Artificial sequence
  Synthetic sequence: Probe suitable for detection of genetic variations associated with IBD
ctacgccggattttagatatcgccg

SEQ ID NO: 846 - DNA, 25 bp, Artificial sequence
  Synthetic sequence: Probe suitable for detection of genetic variations associated with IBD
ctacgccggattctagatatcgccg

SEQ ID NO: 847 - DNA, 25 bp, Artificial sequence
  Synthetic sequence: Probe suitable for detection of genetic variations associated with IBD
tatctaaaatccggcgtagtcctga

SEQ ID NO: 848 - DNA, 25 bp, Artificial sequence
  Synthetic sequence: Probe suitable for detection of genetic variations associated with IBD
tatctaaaatccagcgtagtcctga

SEQ ID NO: 849 - DNA, 25 bp, Artificial sequence
  Synthetic sequence: Probe suitable for detection of genetic variations associated with IBD
tcaggactacgccggattttagata

SEQ ID NO: 850 - DNA, 25 bp, Artificial sequence
  Synthetic sequence: Probe suitable for detection of genetic variations associated with IBD
tcaggactacgctggattttagata

SEQ ID NO: 851 - DNA, 25 bp, Artificial sequence
  Synthetic sequence: Probe suitable for detection of genetic variations associated with IBD
cgtgtgtgtgtatgtgtgtgtgtgt

SEQ ID NO: 852 - DNA, 25 bp, Artificial sequence
  Synthetic sequence: Probe suitable for detection of genetic variations associated with IBD
cgtgtgtgtgtacgtgtgtgtgtgt

SEQ ID NO: 853 - DNA, 25 bp, Artificial sequence
  Synthetic sequence: Probe suitable for detection of genetic variations associated with IBD
acacacacacacatacacacacacg

SEQ ID NO: 854 - DNA, 25 bp, Artificial sequence
  Synthetic sequence: Probe suitable for detection of genetic variations associated with IBD
acacacacacacgtacacacacacg

SEQ ID NO: 855 - DNA, 25 bp, Artificial sequence
  Synthetic sequence: Probe suitable for detection of genetic variations associated with IBD
ttcctgttacggtccccctccctga

SEQ ID NO: 856 - DNA, 25 bp, Artificial sequence
  Synthetic sequence: Probe suitable for detection of genetic variations associated with IBD
ttcctgttacggcccccctccctga

SEQ ID NO: 857 - DNA, 25 bp, Artificial sequence
  Synthetic sequence: Probe suitable for detection of genetic variations associated with IBD
tcagggagggggaccgtaacaggaa

SEQ ID NO: 858 - DNA, 25 bp, Artificial sequence
  Synthetic sequence: Probe suitable for detection of genetic variations associated with IBD
tcagggaggggggccgtaacaggaa

SEQ ID NO: 859 - DNA, 25 bp, Artificial sequence
  Synthetic sequence: Probe suitable for detection of genetic variations associated with IBD
tgcagggggcttgttgggagtaaaa

SEQ ID NO: 860 - DNA, 25 bp, Artificial sequence
  Synthetic sequence: Probe suitable for detection of genetic variations associated with IBD
tgcagggggctttttgggagtaaaa

SEQ ID NO: 861 - DNA, 25 bp, Artificial sequence
  Synthetic sequence: Probe suitable for detection of genetic variations associated with IBD
ttttactcccaacaagccccctgca

SEQ ID NO: 862 - DNA, 25 bp, Artificial sequence
  Synthetic sequence: Probe suitable for detection of genetic variations associated with IBD
ttttactcccaaaaagccccctgca

SEQ ID NO: 863 - DNA, 25 bp, Artificial sequence
  Synthetic sequence: Probe suitable for detection of genetic variations associated with IBD
caatcccaggttctcttttctacct

SEQ ID NO: 864 - DNA, 25 bp, Artificial sequence
  Synthetic sequence: Probe suitable for detection of genetic variations associated with IBD
caatcccaggttttcttttctacct

SEQ ID NO: 865 - DNA, 25 bp, Artificial sequence
  Synthetic sequence: Probe suitable for detection of genetic variations associated with IBD
aggtagaaaagagaacctgggattg

SEQ ID NO: 866 - DNA, 25 bp, Artificial sequence
  Synthetic sequence: Probe suitable for detection of genetic variations associated with IBD
aggtagaaaagaaaacctgggattg

SEQ ID NO: 867 - DNA, 25 bp, Artificial sequence
  Synthetic sequence: Probe suitable for detection of genetic variations associated with IBD
gagccattattgttccgtgctgttc

SEQ ID NO: 868 - DNA, 25 bp, Artificial sequence
  Synthetic sequence: Probe suitable for detection of genetic variations associated with IBD
gagccattattgatccgtgctgttc

SEQ ID NO: 869 - DNA, 25 bp, Artificial sequence
  Synthetic sequence: Probe suitable for detection of genetic variations associated with IBD
gaacagcacggaacaataatggctc

SEQ ID NO: 870 - DNA, 25 bp, Artificial sequence
  Synthetic sequence: Probe suitable for detection of genetic variations associated with IBD
gaacagcacggatcaataatggctc

SEQ ID NO: 871 - DNA, 25 bp, Artificial sequence
  Synthetic sequence: Probe suitable for detection of genetic variations associated with IBD
gcagagggatcctgtcgacccccac

SEQ ID NO: 872 - DNA, 25 bp, Artificial sequence
  Synthetic sequence: Probe suitable for detection of genetic variations associated with IBD
gcagagggatcccgtcgacccccac

SEQ ID NO: 873 - DNA, 25 bp, Artificial sequence
  Synthetic sequence: Probe suitable for detection of genetic variations associated with IBD
gtgggggtcgacaggatccctctgc

SEQ ID NO: 874 - DNA, 25 bp, Artificial sequence
  Synthetic sequence: Probe suitable for detection of genetic variations associated with IBD
gtgggggtcgacgggatccctctgc

SEQ ID NO: 875 - DNA, 25 bp, Artificial sequence
  Synthetic sequence: Probe suitable for detection of genetic variations associated with IBD
gcagaggcagcgggttgtggaaagc

SEQ ID NO: 876 - DNA, 25 bp, Artificial sequence
  Synthetic sequence: Probe suitable for detection of genetic variations associated with IBD
gcagaggcagcgagttgtggaaagc

SEQ ID NO: 877 - DNA, 25 bp, Artificial sequence
  Synthetic sequence: Probe suitable for detection of genetic variations associated with IBD
gctttccacaacccgctgcctctgc

SEQ ID NO: 878 - DNA, 25 bp, Artificial sequence
  Synthetic sequence: Probe suitable for detection of genetic variations associated with IBD
gctttccacaactcgctgcctctgc

SEQ ID NO: 879 - DNA, 25 bp, Artificial sequence
  Synthetic sequence: Probe suitable for detection of genetic variations associated with IBD
ctgctgccatggcgtgtccctctcg

SEQ ID NO: 880 - DNA, 25 bp, Artificial sequence
  Synthetic sequence: Probe suitable for detection of genetic variations associated with IBD
ctgctgccatggtgtgtccctctcg

SEQ ID NO: 881 - DNA, 25 bp, Artificial sequence
  Synthetic sequence: Probe suitable for detection of genetic variations associated with IBD
cgagagggacacgccatggcagcag

SEQ ID NO: 882 - DNA, 25 bp, Artificial sequence
  Synthetic sequence: Probe suitable for detection of genetic variations associated with IBD
cgagagggacacaccatggcagcag

SEQ ID NO: 883 - DNA, 25 bp, Artificial sequence
  Synthetic sequence: Probe suitable for detection of genetic variations associated with IBD
agtgggaattatcaatggactgcaa

SEQ ID NO: 884 - DNA, 25 bp, Artificial sequence
  Synthetic sequence: Probe suitable for detection of genetic variations associated with IBD
agtgggaattattaatggactgcaa

SEQ ID NO: 885 - DNA, 25 bp, Artificial sequence
  Synthetic sequence: Probe suitable for detection of genetic variations associated with IBD
ttgcagtccattgataattcccact

SEQ ID NO: 886 - DNA, 25 bp, Artificial sequence
  Synthetic sequence: Probe suitable for detection of genetic variations associated with IBD
ttgcagtccattaataattcccact

SEQ ID NO: 887 - DNA, 25 bp, Artificial sequence
  Synthetic sequence: Probe suitable for detection of genetic variations associated with IBD
caccaacgggacggagcgcgtgcgg

SEQ ID NO: 888 - DNA, 25 bp, Artificial sequence
  Synthetic sequence: Probe suitable for detection of genetic variations associated with IBD
caccaacgggacagagcgcgtgcgg

SEQ ID NO: 889 - DNA, 25 bp, Artificial sequence
  Synthetic sequence: Probe suitable for detection of genetic variations associated with IBD
caccaacgggaccgagcgcgtgcgg

SEQ ID NO: 890 - DNA, 25 bp, Artificial sequence
  Synthetic sequence: Probe suitable for detection of genetic variations associated with IBD
ccgcacgcgctccgtcccgttggtg

SEQ ID NO: 891 - DNA, 25 bp, Artificial sequence
  Synthetic sequence: Probe suitable for detection of genetic variations associated with IBD
ccgcacgcgctctgtcccgttggtg

SEQ ID NO: 892 - DNA, 25 bp, Artificial sequence
  Synthetic sequence: Probe suitable for detection of genetic variations associated with IBD
ccgcacgcgctcggtcccgttggtg

SEQ ID NO: 893 - DNA, 25 bp, Artificial sequence
  Synthetic sequence: Probe suitable for detection of genetic variations associated with IBD
cgagtactggaacagccagaaggaa

SEQ ID NO: 894 - DNA, 25 bp, Artificial sequence
  Synthetic sequence: Probe suitable for detection of genetic variations associated with IBD
cgagtactggaatagccagaaggaa

SEQ ID NO: 895 - DNA, 25 bp, Artificial sequence
  Synthetic sequence: Probe suitable for detection of genetic variations associated with IBD
ttccttctggctgttccagtactcg

SEQ ID NO: 896 - DNA, 25 bp, Artificial sequence
  Synthetic sequence: Probe suitable for detection of genetic variations associated with IBD
ttccttctggctattccagtactcg

SEQ ID NO: 897 - DNA, 25 bp, Artificial sequence
  Synthetic sequence: Probe suitable for detection of genetic variations associated with IBD
cgaccacgtttcttgtggcagctta

SEQ ID NO: 898 - DNA, 25 bp, Artificial sequence
  Synthetic sequence: Probe suitable for detection of genetic variations associated with IBD
taagctgccacaagaaacgtggtcg

SEQ ID NO: 899 - DNA, 25 bp, Artificial sequence
  Synthetic sequence: Probe suitable for detection of genetic variations associated with IBD
cgaccacgtttcctgtggcagctta

SEQ ID NO: 900 - DNA, 25 bp, Artificial sequence
  Synthetic sequence: Probe suitable for detection of genetic variations associated with IBD
taagctgccacaggaaacgtggtcg

SEQ ID NO: 901 - DNA, 25 bp, Artificial sequence
  Synthetic sequence: Probe suitable for detection of genetic variations associated with IBD
tcttgtggcagcttaagtttgaatg

SEQ ID NO: 902 - DNA, 25 bp, Artificial sequence
  Synthetic sequence: Probe suitable for detection of genetic variations associated with IBD
cattcaaacttaagctgccacaaga

SEQ ID NO: 903 - DNA, 25 bp, Artificial sequence
  Synthetic sequence: Probe suitable for detection of genetic variations associated with IBD
tcttgtggcagcctaagtttgaatg

SEQ ID NO: 904 - DNA, 25 bp, Artificial sequence
  Synthetic sequence: Probe suitable for detection of genetic variations associated with IBD
cattcaaacttaggctgccacaaga

SEQ ID NO: 905 - DNA, 25 bp, Artificial sequence
  Synthetic sequence: Probe suitable for detection of genetic variations associated with IBD
tcttgtggcagcgtaagtttgaatg

SEQ ID NO: 906 - DNA, 25 bp, Artificial sequence
  Synthetic sequence: Probe suitable for detection of genetic variations associated with IBD
cattcaaacttacgctgccacaaga

SEQ ID NO: 907 - DNA, 25 bp, Artificial sequence
  Synthetic sequence: Probe suitable for detection of genetic variations associated with IBD
tcttgtggcagcataagtttgaatg

SEQ ID NO: 908 - DNA, 25 bp, Artificial sequence
  Synthetic sequence: Probe suitable for detection of genetic variations associated with IBD
cattcaaacttatgctgccacaaga

SEQ ID NO: 909 - DNA, 25 bp, Artificial sequence
  Synthetic sequence: Probe suitable for detection of genetic variations associated with IBD
tgtggcagcttaagtttgaatgtca

SEQ ID NO: 910 - DNA, 25 bp, Artificial sequence
  Synthetic sequence: Probe suitable for detection of genetic variations associated with IBD
tgacattcaaacttaagctgccaca

SEQ ID NO: 911 - DNA, 25 bp, Artificial sequence
  Synthetic sequence: Probe suitable for detection of genetic variations associated with IBD
tgtggcagcttacgtttgaatgtca

SEQ ID NO: 912 - DNA, 25 bp, Artificial sequence
  Synthetic sequence: Probe suitable for detection of genetic variations associated with IBD
tgacattcaaacgtaagctgccaca

SEQ ID NO: 913 - DNA, 25 bp, Artificial sequence
  Synthetic sequence: Probe suitable for detection of genetic variations associated with IBD
tgtggcagcttaggtttgaatgtca

SEQ ID NO: 914 - DNA, 25 bp, Artificial sequence
  Synthetic sequence: Probe suitable for detection of genetic variations associated with IBD
tgacattcaaacctaagctgccaca

SEQ ID NO: 915 - DNA, 25 bp, Artificial sequence
  Synthetic sequence: Probe suitable for detection of genetic variations associated with IBD
tgtggcagcttatgtttgaatgtca

SEQ ID NO: 916 - DNA, 25 bp, Artificial sequence
  Synthetic sequence: Probe suitable for detection of genetic variations associated with IBD
tgacattcaaacataagctgccaca

SEQ ID NO: 917 - DNA, 25 bp, Artificial sequence
  Synthetic sequence: Probe suitable for detection of genetic variations associated with IBD
gcttaagtttgaatgtcatttcttc

SEQ ID NO: 918 - DNA, 25 bp, Artificial sequence
  Synthetic sequence: Probe suitable for detection of genetic variations associated with IBD
gaagaaatgacattcaaacttaagc

SEQ ID NO: 919 - DNA, 25 bp, Artificial sequence
  Synthetic sequence: Probe suitable for detection of genetic variations associated with IBD
gcttaagtttgagtgtcatttcttc

SEQ ID NO: 920 - DNA, 25 bp, Artificial sequence
  Synthetic sequence: Probe suitable for detection of genetic variations associated with IBD
gaagaaatgacactcaaacttaagc

SEQ ID NO: 921 - DNA, 25 bp, Artificial sequence
  Synthetic sequence: Probe suitable for detection of genetic variations associated with IBD
cggagcgggtgcggttgctggaaag

SEQ ID NO: 922 - DNA, 25 bp, Artificial sequence
  Synthetic sequence: Probe suitable for detection of genetic variations associated with IBD
ctttccagcaaccgcacccgctccg

SEQ ID NO: 923 - DNA, 25 bp, Artificial sequence
  Synthetic sequence: Probe suitable for detection of genetic variations associated with IBD
cggagcgggtgcagttgctggaaag

SEQ ID NO: 924 - DNA, 25 bp, Artificial sequence
  Synthetic sequence: Probe suitable for detection of genetic variations associated with IBD
ctttccagcaactgcacccgctccg

SEQ ID NO: 925 - DNA, 25 bp, Artificial sequence
  Synthetic sequence: Probe suitable for detection of genetic variations associated with IBD
cggagcgggtgctgttgctggaaag

SEQ ID NO: 926 - DNA, 25 bp, Artificial sequence
  Synthetic sequence: Probe suitable for detection of genetic variations associated with IBD
ctttccagcaacagcacccgctccg

SEQ ID NO: 927 - DNA, 25 bp, Artificial sequence
  Synthetic sequence: Probe suitable for detection of genetic variations associated with IBD
ttgctggaaagatgcatctataacc

SEQ ID NO: 928 - DNA, 25 bp, Artificial sequence
  Synthetic sequence: Probe suitable for detection of genetic variations associated with IBD
ggttatagatgcatctttccagcaa

SEQ ID NO: 929 - DNA, 25 bp, Artificial sequence
  Synthetic sequence: Probe suitable for detection of genetic variations associated with IBD
ttgctggaaagacgcatctataacc

SEQ ID NO: 930 - DNA, 25 bp, Artificial sequence
  Synthetic sequence: Probe suitable for detection of genetic variations associated with IBD
ggttatagatgcgtctttccagcaa

SEQ ID NO: 931 - DNA, 25 bp, Artificial sequence
  Synthetic sequence: Probe suitable for detection of genetic variations associated with IBD
ttgctggaaagaggcatctataacc

SEQ ID NO: 932 - DNA, 25 bp, Artificial sequence
  Synthetic sequence: Probe suitable for detection of genetic variations associated with IBD
ggttatagatgcctctttccagcaa

SEQ ID NO: 933 - DNA, 25 bp, Artificial sequence
  Synthetic sequence: Probe suitable for detection of genetic variations associated with IBD
agatgcatctataaccaagaggagt

SEQ ID NO: 934 - DNA, 25 bp, Artificial sequence
  Synthetic sequence: Probe suitable for detection of genetic variations associated with IBD
actcctcttggttatagatgcatct

SEQ ID NO: 935 - DNA, 25 bp, Artificial sequence
  Synthetic sequence: Probe suitable for detection of genetic variations associated with IBD
agatgcatctatcaccaagaggagt

SEQ ID NO: 936 - DNA, 25 bp, Artificial sequence
  Synthetic sequence: Probe suitable for detection of genetic variations associated with IBD
actcctcttggtgatagatgcatct

SEQ ID NO: 937 - DNA, 25 bp, Artificial sequence
  Synthetic sequence: Probe suitable for detection of genetic variations associated with IBD
agatgcatctataccaagaggagtc

SEQ ID NO: 938 - DNA, 25 bp, Artificial sequence
  Synthetic sequence: Probe suitable for detection of genetic variations associated with IBD
gactcctcttggtatagatgcatct

SEQ ID NO: 939 - DNA, 25 bp, Artificial sequence
  Synthetic sequence: Probe suitable for detection of genetic variations associated with IBD
agccagaaggacctcctggagcaga

SEQ ID NO: 940 - DNA, 25 bp, Artificial sequence
  Synthetic sequence: Probe suitable for detection of genetic variations associated with IBD
tctgctccaggaggtccttctggct

SEQ ID NO: 941 - DNA, 25 bp, Artificial sequence
  Synthetic sequence: Probe suitable for detection of genetic variations associated with IBD
agccagaaggacatcctggagcaga

SEQ ID NO: 942 - DNA, 25 bp, Artificial sequence
  Synthetic sequence: Probe suitable for detection of genetic variations associated with IBD
tctgctccaggatgtccttctggct

SEQ ID NO: 943 - DNA, 25 bp, Artificial sequence
  Synthetic sequence: Probe suitable for detection of genetic variations associated with IBD
agccagaaggacttcctggagcaga

SEQ ID NO: 944 - DNA, 25 bp, Artificial sequence
  Synthetic sequence: Probe suitable for detection of genetic variations associated with IBD
tctgctccaggaagtccttctggct

SEQ ID NO: 945 - DNA, 25 bp, Artificial sequence
  Synthetic sequence: Probe suitable for detection of genetic variations associated with IBD
agcagaggcgggccgcggtggacac

SEQ ID NO: 946 - DNA, 25 bp, Artificial sequence
  Synthetic sequence: Probe suitable for detection of genetic variations associated with IBD
gtgtccaccgcggcccgcctctgct

SEQ ID NO: 947 - DNA, 25 bp, Artificial sequence
  Synthetic sequence: Probe suitable for detection of genetic variations associated with IBD
agcagaggcggggcgcggtggacac

SEQ ID NO: 948 - DNA, 25 bp, Artificial sequence
  Synthetic sequence: Probe suitable for detection of genetic variations associated with IBD
gtgtccaccgcgccccgcctctgct

SEQ ID NO: 949 - DNA, 25 bp, Artificial sequence
  Synthetic sequence: Probe suitable for detection of genetic variations associated with IBD
ccaactagttgctggatacttgcaa

SEQ ID NO: 950 - DNA, 25 bp, Artificial sequence
  Synthetic sequence: Probe suitable for detection of genetic variations associated with IBD
ccaactagttgccggatacttgcaa

SEQ ID NO: 951 - DNA, 25 bp, Artificial sequence
  Synthetic sequence: Probe suitable for detection of genetic variations associated with IBD
ttgcaagtatccagcaactagttgg

SEQ ID NO: 952 - DNA, 25 bp, Artificial sequence
  Synthetic sequence: Probe suitable for detection of genetic variations associated with IBD
ttgcaagtatccggcaactagttgg

SEQ ID NO: 953 - DNA, 25 bp, Artificial sequence
  Synthetic sequence: Probe suitable for detection of genetic variations associated with IBD
ttgccaggaaagccaatgtatgtgg

SEQ ID NO: 954 - DNA, 25 bp, Artificial sequence
  Synthetic sequence: Probe suitable for detection of genetic variations associated with IBD
ttgccaggaaagtcaatgtatgtgg

SEQ ID NO: 955 - DNA, 25 bp, Artificial sequence
  Synthetic sequence: Probe suitable for detection of genetic variations associated with IBD
ccacatacattggctttcctggcaa

SEQ ID NO: 956 - DNA, 25 bp, Artificial sequence
  Synthetic sequence: Probe suitable for detection of genetic variations associated with IBD
ccacatacattgactttcctggcaa

SEQ ID NO: 957 - DNA, 25 bp, Artificial sequence
  Synthetic sequence: Probe suitable for detection of genetic variations associated with IBD
acctatcttcttcgacacatgggat

SEQ ID NO: 958 - DNA, 25 bp, Artificial sequence
  Synthetic sequence: Probe suitable for detection of genetic variations associated with IBD
acctatcttctttgacacatgggat

SEQ ID NO: 959 - DNA, 25 bp, Artificial sequence
  Synthetic sequence: Probe suitable for detection of genetic variations associated with IBD
atcccatgtgtcgaagaagataggt

SEQ ID NO: 960 - DNA, 25 bp, Artificial sequence
  Synthetic sequence: Probe suitable for detection of genetic variations associated with IBD
atcccatgtgtcaaagaagataggt

SEQ ID NO: 961 - DNA, 25 bp, Artificial sequence
  Synthetic sequence: Probe suitable for detection of genetic variations associated with adverse reactions to pharmaceuticals
aaggccttccagcgactgctctgct

SEQ ID NO: 962 - DNA, 25 bp, Artificial sequence
  Synthetic sequence: Probe suitable for detection of genetic variations associated with adverse reactions to pharmaceuticals
aaggccttccagggactgctctgct

SEQ ID NO: 963 - DNA, 25 bp, Artificial sequence
  Synthetic sequence: Probe suitable for detection of genetic variations associated with adverse reactions to pharmaceuticals
agcagagcagtcgctggaaggcctt

SEQ ID NO: 964 - DNA, 25 bp, Artificial sequence
  Synthetic sequence: Probe suitable for detection of genetic variations associated with adverse reactions to pharmaceuticals
agcagagcagtccctggaaggcctt

SEQ ID NO: 965 - DNA, 25 bp, Artificial sequence
  Synthetic sequence: Probe suitable for detection of genetic variations associated with adverse reactions to pharmaceuticals
ctggcacccaatggaagccatgcgc

SEQ ID NO: 966 - DNA, 25 bp, Artificial sequence
  Synthetic sequence: Probe suitable for detection of genetic variations associated with adverse reactions to pharmaceuticals
ctggcacccaatagaagccatgcgc

SEQ ID NO: 967 - DNA, 25 bp, Artificial sequence
  Synthetic sequence: Probe suitable for detection of genetic variations associated with adverse reactions to pharmaceuticals
gcgcatggcttccattgggtgccag

SEQ ID NO: 968 - DNA, 25 bp, Artificial sequence
  Synthetic sequence: Probe suitable for detection of genetic variations associated with adverse reactions to pharmaceuticals
gcgcatggcttctattgggtgccag

SEQ ID NO: 969 - DNA, 25 bp, Artificial sequence
  Synthetic sequence: Probe suitable for detection of genetic variations associated with adverse reactions to pharmaceuticals
gacgtcacgcagcaaagggacgagg

SEQ ID NO: 970 - DNA, 25 bp, Artificial sequence
  Synthetic sequence: Probe suitable for detection of genetic variations associated with adverse reactions to pharmaceuticals
gacgtcacgcaggaaagggacgagg

SEQ ID NO: 971 - DNA, 25 bp, Artificial sequence
  Synthetic sequence: Probe suitable for detection of genetic variations associated with adverse reactions to pharmaceuticals
cctcgtccctttgctgcgtgacgtc

SEQ ID NO: 972 - DNA, 25 bp, Artificial sequence
  Synthetic sequence: Probe suitable for detection of genetic variations associated with adverse reactions to pharmaceuticals
cctcgtccctttcctgcgtgacgtc

SEQ ID NO: 973 - DNA, 25 bp, Artificial sequence
  Synthetic sequence: Probe suitable for detection of genetic variations associated with adverse reactions to pharmaceuticals
agttcaggtggccactcagctggct

SEQ ID NO: 974 - DNA, 25 bp, Artificial sequence
  Synthetic sequence: Probe suitable for detection of genetic variations associated with adverse reactions to pharmaceuticals
agttcaggtggctactcagctggct

SEQ ID NO: 975 - DNA, 25 bp, Artificial sequence
  Synthetic sequence: Probe suitable for detection of genetic variations associated with adverse reactions to pharmaceuticals
agccagctgagtggccacctgaact

SEQ ID NO: 976 - DNA, 25 bp, Artificial sequence
  Synthetic sequence: Probe suitable for detection of genetic variations associated with adverse reactions to pharmaceuticals
agccagctgagtagccacctgaact

SEQ ID NO: 977 - DNA, 25 bp, Artificial sequence
  Synthetic sequence: Probe suitable for detection of genetic variations associated with adverse reactions to pharmaceuticals
ctaggaaagcagcattctgaagagg

SEQ ID NO: 978 - DNA, 25 bp, Artificial sequence
  Synthetic sequence: Probe suitable for detection of genetic variations associated with adverse reactions to pharmaceuticals
ctaggaaagcagtattctgaagagg

SEQ ID NO: 979 - DNA, 25 bp, Artificial sequence
  Synthetic sequence: Probe suitable for detection of genetic variations associated with adverse reactions to pharmaceuticals
cctcttcagaatgctgctttcctag

SEQ ID NO: 980 - DNA, 25 bp, Artificial sequence
  Synthetic sequence: Probe suitable for detection of genetic variations associated with adverse reactions to pharmaceuticals
cctcttcagaatactgctttcctag

SEQ ID NO: 981 - DNA, 25 bp, Artificial sequence
  Synthetic sequence: Probe suitable for detection of genetic variations associated with adverse reactions to pharmaceuticals
gttagcttctccggagttaaagtca

SEQ ID NO: 982 - DNA, 25 bp, Artificial sequence
  Synthetic sequence: Probe suitable for detection of genetic variations associated with adverse reactions to pharmaceuticals
gttagcttctccagagttaaagtca

SEQ ID NO: 983 - DNA, 25 bp, Artificial sequence
  Synthetic sequence: Probe suitable for detection of genetic variations associated with adverse reactions to pharmaceuticals
tgactttaactccggagaagctaac

SEQ ID NO: 984 - DNA, 25 bp, Artificial sequence
  Synthetic sequence: Probe suitable for detection of genetic variations associated with adverse reactions to pharmaceuticals
tgactttaactctggagaagctaac

SEQ ID NO: 985 - DNA, 25 bp, Artificial sequence
  Synthetic sequence: Probe suitable for detection of genetic variations associated with adverse reactions to pharmaceuticals
gatttcgctggcgtgaaggacaagg

SEQ ID NO: 986 - DNA, 25 bp, Artificial sequence
  Synthetic sequence: Probe suitable for detection of genetic variations associated with adverse reactions to pharmaceuticals
gatttcgctggcatgaaggacaagg

SEQ ID NO: 987 - DNA, 25 bp, Artificial sequence
  Synthetic sequence: Probe suitable for detection of genetic variations associated with adverse reactions to pharmaceuticals
ccttgtccttcacgccagcgaaatc

SEQ ID NO: 988 - DNA, 25 bp, Artificial sequence
  Synthetic sequence: Probe suitable for detection of genetic variations associated with adverse reactions to pharmaceuticals
ccttgtccttcatgccagcgaaatc

SEQ ID NO: 989 - DNA, 25 bp, Artificial sequence
  Synthetic sequence: Probe suitable for detection of genetic variations associated with adverse reactions to pharmaceuticals
cgctgcaaatacatctccctcatct

SEQ ID NO: 990 - DNA, 25 bp, Artificial sequence
  Synthetic sequence: Probe suitable for detection of genetic variations associated with adverse reactions to pharmaceuticals
cgctgcaaatacgtctccctcatct

SEQ ID NO: 991 - DNA, 25 bp, Artificial sequence
  Synthetic sequence: Probe suitable for detection of genetic variations associated with adverse reactions to pharmaceuticals
agatgagggagatgtatttgcagcg

SEQ ID NO: 992 - DNA, 25 bp, Artificial sequence
  Synthetic sequence: Probe suitable for detection of genetic variations associated with adverse reactions to pharmaceuticals
agatgagggagacgtatttgcagcg

SEQ ID NO: 993 - DNA, 25 bp, Artificial sequence
  Synthetic sequence: Probe suitable for detection of genetic variations associated with adverse reactions to pharmaceuticals
gcttccgaggaagggcagaatggaa

SEQ ID NO: 994 - DNA, 25 bp, Artificial sequence
  Synthetic sequence: Probe suitable for detection of genetic variations associated with adverse reactions to pharmaceuticals
gcttccgaggaatggcagaatggaa

SEQ ID NO: 995 - DNA, 25 bp, Artificial sequence
  Synthetic sequence: Probe suitable for detection of genetic variations associated with adverse reactions to pharmaceuticals
ttccattctgcccttcctcggaagc

SEQ ID NO: 996 - DNA, 25 bp, Artificial sequence
  Synthetic sequence: Probe suitable for detection of genetic variations associated with adverse reactions to pharmaceuticals
ttccattctgccattcctcggaagc

SEQ ID NO: 997 - DNA, 25 bp, Artificial sequence
  Synthetic sequence: Probe suitable for detection of genetic variations associated with adverse reactions to pharmaceuticals
ggctgccctcccggaggtaaggcct

SEQ ID NO: 998 - DNA, 25 bp, Artificial sequence
  Synthetic sequence: Probe suitable for detection of genetic variations associated with adverse reactions to pharmaceuticals
ggctgccctcccagaggtaaggcct

SEQ ID NO: 999 - DNA, 25 bp, Artificial sequence
  Synthetic sequence: Probe suitable for detection of genetic variations associated with adverse reactions to pharmaceuticals
aggccttacctccgggagggcagcc

SEQ ID NO: 1000 - DNA, 25 bp, Artificial sequence
  Synthetic sequence: Probe suitable for detection of genetic variations associated with adverse reactions to pharmaceuticals
aggccttacctctgggagggcagcc

SEQ ID NO: 1001 - DNA, 25 bp, Artificial sequence
  Synthetic sequence: Probe suitable for detection of genetic variations associated with adverse reactions to pharmaceuticals
atcggtgagaccattgcccgctggg

SEQ ID NO: 1002 - DNA, 25 bp, Artificial sequence
  Synthetic sequence: Probe suitable for detection of genetic variations associated with adverse reactions to pharmaceuticals
atcggtgagaccgttgcccgctggg

SEQ ID NO: 1003 - DNA, 25 bp, Artificial sequence
  Synthetic sequence: Probe suitable for detection of genetic variations associated with adverse reactions to pharmaceuticals
cccagcgggcaatggtctcaccgat

SEQ ID NO: 1004 - DNA, 25 bp, Artificial sequence
  Synthetic sequence: Probe suitable for detection of genetic variations associated with adverse reactions to pharmaceuticals
cccagcgggcaacggtctcaccgat

SEQ ID NO: 1005 - DNA, 25 bp, Artificial sequence
  Synthetic sequence: Probe suitable for detection of genetic variations associated with adverse reactions to pharmaceuticals
taccaaatgagcattagctactttt

SEQ ID NO: 1006 - DNA, 25 bp, Artificial sequence
  Synthetic sequence: Probe suitable for detection of genetic variations associated with adverse reactions to pharmaceuticals
taccaaatgagccttagctactttt

SEQ ID NO: 1007 - DNA, 25 bp, Artificial sequence
  Synthetic sequence: Probe suitable for detection of genetic variations associated with adverse reactions to pharmaceuticals
aaaagtagctaatgctcatttggta

SEQ ID NO: 1008 - DNA, 25 bp, Artificial sequence
  Synthetic sequence: Probe suitable for detection of genetic variations associated with adverse reactions to pharmaceuticals
aaaagtagctaaggctcatttggta

SEQ ID NO: 1009 - DNA, 25 bp, Artificial sequence
  Synthetic sequence: Probe suitable for detection of genetic variations associated with adverse reactions to pharmaceuticals
tgccatctaaccatcttttcttctc

SEQ ID NO: 1010 - DNA, 25 bp, Artificial sequence
  Synthetic sequence: Probe suitable for detection of genetic variations associated with adverse reactions to pharmaceuticals
tgccatctaaccgtcttttcttctc

SEQ ID NO: 1011 - DNA, 25 bp, Artificial sequence
  Synthetic sequence: Probe suitable for detection of genetic variations associated with adverse reactions to pharmaceuticals
gagaagaaaagatggttagatggca

SEQ ID NO: 1012 - DNA, 25 bp, Artificial sequence
  Synthetic sequence: Probe suitable for detection of genetic variations associated with adverse reactions to pharmaceuticals
gagaagaaaagacggttagatggca

SEQ ID NO: 1013 - DNA, 25 bp, Artificial sequence
  Synthetic sequence: Probe suitable for detection of genetic variations associated with adverse reactions to pharmaceuticals
gctgctccctgacgggagccagtgt

SEQ ID NO: 1014 - DNA, 25 bp, Artificial sequence
  Synthetic sequence: Probe suitable for detection of genetic variations associated with adverse reactions to pharmaceuticals
gctgctccctgatgggagccagtgt

SEQ ID NO: 1015 - DNA, 25 bp, Artificial sequence
  Synthetic sequence: Probe suitable for detection of genetic variations associated with adverse reactions to pharmaceuticals
acactggctcccgtcagggagcagc

SEQ ID NO: 1016 - DNA, 25 bp, Artificial sequence
  Synthetic sequence: Probe suitable for detection of genetic variations associated with adverse reactions to pharmaceuticals
acactggctcccatcagggagcagc

SEQ ID NO: 1017 - DNA, 25 bp, Artificial sequence
  Synthetic sequence: Probe suitable for detection of genetic variations associated with adverse reactions to pharmaceuticals
agcattgaggaccgtgttcaagagg

SEQ ID NO: 1018 - DNA, 25 bp, Artificial sequence
  Synthetic sequence: Probe suitable for detection of genetic variations associated with adverse reactions to pharmaceuticals
agcattgaggactgtgttcaagagg

SEQ ID NO: 1019 - DNA, 25 bp, Artificial sequence
  Synthetic sequence: Probe suitable for detection of genetic variations associated with adverse reactions to pharmaceuticals
cctcttgaacacggtcctcaatgct

SEQ ID NO: 1020 - DNA, 25 bp, Artificial sequence
  Synthetic sequence: Probe suitable for detection of genetic variations associated with adverse reactions to pharmaceuticals
cctcttgaacacagtcctcaatgct

SEQ ID NO: 1021 - DNA, 25 bp, Artificial sequence
  Synthetic sequence: Probe suitable for detection of genetic variations associated with adverse reactions to pharmaceuticals
gtccagagatacattgaccttctcc

SEQ ID NO: 1022 - DNA, 25 bp, Artificial sequence
  Synthetic sequence: Probe suitable for detection of genetic variations associated with adverse reactions to pharmaceuticals
gtccagagataccttgaccttctcc

SEQ ID NO: 1023 - DNA, 25 bp, Artificial sequence
  Synthetic sequence: Probe suitable for detection of genetic variations associated with adverse reactions to pharmaceuticals
ggagaaggtcaatgtatctctggac

SEQ ID NO: 1024 - DNA, 25 bp, Artificial sequence
  Synthetic sequence: Probe suitable for detection of genetic variations associated with adverse reactions to pharmaceuticals
ggagaaggtcaaggtatctctggac

SEQ ID NO: 1025 - DNA, 25 bp, Artificial sequence
  Synthetic sequence: Probe suitable for detection of genetic variations associated with adverse reactions to pharmaceuticals
tgaaaatggagaaggtaaaatgtaa

SEQ ID NO: 1026 - DNA, 25 bp, Artificial sequence
  Synthetic sequence: Probe suitable for detection of genetic variations associated with adverse reactions to pharmaceuticals
tgaaaatggagaggtaaaatgtaaa

SEQ ID NO: 1027 - DNA, 25 bp, Artificial sequence
  Synthetic sequence: Probe suitable for detection of genetic variations associated with adverse reactions to pharmaceuticals
ttacattttaccttctccattttca

SEQ ID NO: 1028 - DNA, 25 bp, Artificial sequence
  Synthetic sequence: Probe suitable for detection of genetic variations associated with adverse reactions to pharmaceuticals
tttacattttacctctccattttca

SEQ ID NO: 1029 - DNA, 25 bp, Artificial sequence
  Synthetic sequence: Probe suitable for detection of genetic variations associated with adverse reactions to pharmaceuticals
tccagagatacattgaccttctccc

SEQ ID NO: 1030 - DNA, 25 bp, Artificial sequence
  Synthetic sequence: Probe suitable for detection of genetic variations associated with adverse reactions to pharmaceuticals
tccagagatacactgaccttctccc

SEQ ID NO: 1031 - DNA, 25 bp, Artificial sequence
  Synthetic sequence: Probe suitable for detection of genetic variations associated with adverse reactions to pharmaceuticals
gggagaaggtcaatgtatctctgga

SEQ ID NO: 1032 - DNA, 25 bp, Artificial sequence
  Synthetic sequence: Probe suitable for detection of genetic variations associated with adverse reactions to pharmaceuticals
gggagaaggtcagtgtatctctgga

SEQ ID NO: 1033 - DNA, 25 bp, Artificial sequence
  Synthetic sequence: Probe suitable for detection of genetic variations associated with adverse reactions to pharmaceuticals
gagatacattgaccttctccccacc

SEQ ID NO: 1034 - DNA, 25 bp, Artificial sequence
  Synthetic sequence: Probe suitable for detection of genetic variations associated with adverse reactions to pharmaceuticals
gagatacattgagcttctccccacc

SEQ ID NO: 1035 - DNA, 25 bp, Artificial sequence
  Synthetic sequence: Probe suitable for detection of genetic variations associated with adverse reactions to pharmaceuticals
ggtggggagaaggtcaatgtatctc

SEQ ID NO: 1036 - DNA, 25 bp, Artificial sequence
  Synthetic sequence: Probe suitable for detection of genetic variations associated with adverse reactions to pharmaceuticals
ggtggggagaagctcaatgtatctc

SEQ ID NO: 1037 - DNA, 25 bp, Artificial sequence
  Synthetic sequence: Probe suitable for detection of genetic variations associated with adverse reactions to pharmaceuticals
tgcacatccggaggtaggatcatga

SEQ ID NO: 1038 - DNA, 25 bp, Artificial sequence
  Synthetic sequence: Probe suitable for detection of genetic variations associated with adverse reactions to pharmaceuticals
tgcacatccggatgtaggatcatga

SEQ ID NO: 1039 - DNA, 25 bp, Artificial sequence
  Synthetic sequence: Probe suitable for detection of genetic variations associated with adverse reactions to pharmaceuticals
tcatgatcctacctccggatgtgca

SEQ ID NO: 1040 - DNA, 25 bp, Artificial sequence
  Synthetic sequence: Probe suitable for detection of genetic variations associated with adverse reactions to pharmaceuticals
tcatgatcctacatccggatgtgca

SEQ ID NO: 1041 - DNA, 25 bp, Artificial sequence
  Synthetic sequence: Probe suitable for detection of genetic variations associated with adverse reactions to pharmaceuticals
gcgcttctccgtgtccaccttgcgc

SEQ ID NO: 1042 - DNA, 25 bp, Artificial sequence
  Synthetic sequence: Probe suitable for detection of genetic variations associated with adverse reactions to pharmaceuticals
gcgcttctccgtctccaccttgcgc

SEQ ID NO: 1043 - DNA, 25 bp, Artificial sequence
  Synthetic sequence: Probe suitable for detection of genetic variations associated with adverse reactions to pharmaceuticals
gcgcaaggtggacacggagaagcgc

SEQ ID NO: 1044 - DNA, 25 bp, Artificial sequence
  Synthetic sequence: Probe suitable for detection of genetic variations associated with adverse reactions to pharmaceuticals
gcgcaaggtggagacggagaagcgc

SEQ ID NO: 1045 - DNA, 25 bp, Artificial sequence
  Synthetic sequence: Probe suitable for detection of genetic variations associated with adverse reactions to pharmaceuticals
gtgcccctggccgtgatagtggcca

SEQ ID NO: 1046 - DNA, 25 bp, Artificial sequence
  Synthetic sequence: Probe suitable for detection of genetic variations associated with adverse reactions to pharmaceuticals
gtgcccctggccatgatagtggcca

SEQ ID NO: 1047 - DNA, 25 bp, Artificial sequence
  Synthetic sequence: Probe suitable for detection of genetic variations associated with adverse reactions to pharmaceuticals
tggccactatcacggccaggggcac

SEQ ID NO: 1048 - DNA, 25 bp, Artificial sequence
  Synthetic sequence: Probe suitable for detection of genetic variations associated with adverse reactions to pharmaceuticals
tggccactatcatggccaggggcac

SEQ ID NO: 1049 - DNA, 25 bp, Artificial sequence
  Synthetic sequence: Probe suitable for detection of genetic variations associated with adverse reactions to pharmaceuticals
gcggcgccgcaactgcagagggagg

SEQ ID NO: 1050 - DNA, 25 bp, Artificial sequence
  Synthetic sequence: Probe suitable for detection of genetic variations associated with adverse reactions to pharmaceuticals
gcggcgccgcaagtgcagagggagg

SEQ ID NO: 1051 - DNA, 25 bp, Artificial sequence
  Synthetic sequence: Probe suitable for detection of genetic variations associated with adverse reactions to pharmaceuticals
cctccctctgcagttgcggcgccgc

SEQ ID NO: 1052 - DNA, 25 bp, Artificial sequence
  Synthetic sequence: Probe suitable for detection of genetic variations associated with adverse reactions to pharmaceuticals
cctccctctgcacttgcggcgccgc

SEQ ID NO: 1053 - DNA, 25 bp, Artificial sequence
  Synthetic sequence: Probe suitable for detection of genetic variations associated with adverse reactions to pharmaceuticals
gatcctgggtttcgggccgcgttcc

SEQ ID NO: 1054 - DNA, 25 bp, Artificial sequence
  Synthetic sequence: Probe suitable for detection of genetic variations associated with adverse reactions to pharmaceuticals
gatcctgggttttgggccgcgttcc

SEQ ID NO: 1055 - DNA, 25 bp, Artificial sequence
  Synthetic sequence: Probe suitable for detection of genetic variations associated with adverse reactions to pharmaceuticals
ggaacgcggcccgaaacccaggatc

SEQ ID NO: 1056 - DNA, 25 bp, Artificial sequence
  Synthetic sequence: Probe suitable for detection of genetic variations associated with adverse reactions to pharmaceuticals
ggaacgcggcccaaaacccaggatc

SEQ ID NO: 1057 - DNA, 25 bp, Artificial sequence
  Synthetic sequence: Probe suitable for detection of genetic variations associated with adverse reactions to pharmaceuticals
ctttcctggtgagcccatcccccta

SEQ ID NO: 1058 - DNA, 25 bp, Artificial sequence
  Synthetic sequence: Probe suitable for detection of genetic variations associated with adverse reactions to pharmaceuticals
ctttcctggtgaccccatcccccta

SEQ ID NO: 1059 - DNA, 25 bp, Artificial sequence
  Synthetic sequence: Probe suitable for detection of genetic variations associated with adverse reactions to pharmaceuticals
tagggggatgggctcaccaggaaag

SEQ ID NO: 1060 - DNA, 25 bp, Artificial sequence
  Synthetic sequence: Probe suitable for detection of genetic variations associated with adverse reactions to pharmaceuticals
tagggggatggggtcaccaggaaag

SEQ ID NO: 1061 - DNA, 25 bp, Artificial sequence
  Synthetic sequence: Probe suitable for detection of genetic variations associated with adverse reactions to pharmaceuticals
ctcccacccccaggacgcccctttc

SEQ ID NO: 1062 - DNA, 25 bp, Artificial sequence
  Synthetic sequence: Probe suitable for detection of genetic variations associated with adverse reactions to pharmaceuticals
ctcccacccccaagacgcccctttc

SEQ ID NO: 1063 - DNA, 25 bp, Artificial sequence
  Synthetic sequence: Probe suitable for detection of genetic variations associated with adverse reactions to pharmaceuticals
gaaaggggcgtcctgggggtgggag

SEQ ID NO: 1064 - DNA, 25 bp, Artificial sequence
  Synthetic sequence: Probe suitable for detection of genetic variations associated with adverse reactions to pharmaceuticals
gaaaggggcgtcttgggggtgggag

SEQ ID NO: 1065 - DNA, 25 bp, Artificial sequence
  Synthetic sequence: Probe suitable for detection of genetic variations associated with adverse reactions to pharmaceuticals
cttggaagaacccggtctctacaaa

SEQ ID NO: 1066 - DNA, 25 bp, Artificial sequence
  Synthetic sequence: Probe suitable for detection of genetic variations associated with adverse reactions to pharmaceuticals
cttggaagaaccgggtctctacaaa

SEQ ID NO: 1067 - DNA, 25 bp, Artificial sequence
  Synthetic sequence: Probe suitable for detection of genetic variations associated with adverse reactions to pharmaceuticals
tttgtagagaccgggttcttccaag

SEQ ID NO: 1068 - DNA, 25 bp, Artificial sequence
  Synthetic sequence: Probe suitable for detection of genetic variations associated with adverse reactions to pharmaceuticals
tttgtagagacccggttcttccaag

SEQ ID NO: 1069 - DNA, 25 bp, Artificial sequence
  Synthetic sequence: Probe suitable for detection of genetic variations associated with adverse reactions to pharmaceuticals
gctgcacgctacccaccaggccccc

SEQ ID NO: 1070 - DNA, 25 bp, Artificial sequence
  Synthetic sequence: Probe suitable for detection of genetic variations associated with adverse reactions to pharmaceuticals
gctgcacgctactcaccaggccccc

SEQ ID NO: 1071 - DNA, 25 bp, Artificial sequence
  Synthetic sequence: Probe suitable for detection of genetic variations associated with adverse reactions to pharmaceuticals
gggggcctggtgggtagcgtgcagc

SEQ ID NO: 1072 - DNA, 25 bp, Artificial sequence
  Synthetic sequence: Probe suitable for detection of genetic variations associated with adverse reactions to pharmaceuticals
gggggcctggtgagtagcgtgcagc

SEQ ID NO: 1073 - DNA, 25 bp, Artificial sequence
  Synthetic sequence: Probe suitable for detection of genetic variations associated with adverse reactions to pharmaceuticals
gctgggcaacctgctgcatgtggac

SEQ ID NO: 1074 - DNA, 25 bp, Artificial sequence
  Synthetic sequence: Probe suitable for detection of genetic variations associated with adverse reactions to pharmaceuticals
gctgggcaaccttgctgcatgtgga

SEQ ID NO: 1075 - DNA, 25 bp, Artificial sequence
  Synthetic sequence: Probe suitable for detection of genetic variations associated with adverse reactions to pharmaceuticals
gtccacatgcagcaggttgcccagc

SEQ ID NO: 1076 - DNA, 25 bp, Artificial sequence
  Synthetic sequence: Probe suitable for detection of genetic variations associated with adverse reactions to pharmaceuticals
tccacatgcagcaaggttgcccagc

SEQ ID NO: 1077 - DNA, 25 bp, Artificial sequence
  Synthetic sequence: Probe suitable for detection of genetic variations associated with adverse reactions to pharmaceuticals
ctgtgcccatcacccagatcctggg

SEQ ID NO: 1078 - DNA, 25 bp, Artificial sequence
  Synthetic sequence: Probe suitable for detection of genetic variations associated with adverse reactions to pharmaceuticals
ctgtgcccatcatccagatcctggg

SEQ ID NO: 1079 - DNA, 25 bp, Artificial sequence
  Synthetic sequence: Probe suitable for detection of genetic variations associated with adverse reactions to pharmaceuticals
cccaggatctgggtgatgggcacag

SEQ ID NO: 1080 - DNA, 25 bp, Artificial sequence
  Synthetic sequence: Probe suitable for detection of genetic variations associated with adverse reactions to pharmaceuticals
cccaggatctggatgatgggcacag

SEQ ID NO: 1081 - DNA, 25 bp, Artificial sequence
  Synthetic sequence: Probe suitable for detection of genetic variations associated with adverse reactions to pharmaceuticals
aggcgcttctccgtgtccaccttgc

SEQ ID NO: 1082 - DNA, 25 bp, Artificial sequence
  Synthetic sequence: Probe suitable for detection of genetic variations associated with adverse reactions to pharmaceuticals
aggcgcttctccatgtccaccttgc

SEQ ID NO: 1083 - DNA, 25 bp, Artificial sequence
  Synthetic sequence: Probe suitable for detection of genetic variations associated with adverse reactions to pharmaceuticals
gcaaggtggacacggagaagcgcct

SEQ ID NO: 1084 - DNA, 25 bp, Artificial sequence
  Synthetic sequence: Probe suitable for detection of genetic variations associated with adverse reactions to pharmaceuticals
gcaaggtggacatggagaagcgcct

SEQ ID NO: 1085 - DNA, 25 bp, Artificial sequence
  Synthetic sequence: Probe suitable for detection of genetic variations associated with adverse reactions to pharmaceuticals
tcgctggagcagtgggtgaccgagg

SEQ ID NO: 1086 - DNA, 25 bp, Artificial sequence
  Synthetic sequence: Probe suitable for detection of genetic variations associated with adverse reactions to pharmaceuticals
tcgctggagcaggggtgaccgagga

SEQ ID NO: 1087 - DNA, 25 bp, Artificial sequence
  Synthetic sequence: Probe suitable for detection of genetic variations associated with adverse reactions to pharmaceuticals
cctcggtcacccactgctccagcga

SEQ ID NO: 1088 - DNA, 25 bp, Artificial sequence
  Synthetic sequence: Probe suitable for detection of genetic variations associated with adverse reactions to pharmaceuticals
tcctcggtcacccctgctccagcga

SEQ ID NO: 1089 - DNA, 25 bp, Artificial sequence
  Synthetic sequence: Probe suitable for detection of genetic variations associated with adverse reactions to pharmaceuticals
gccaaccactccggtgggtgatggg

SEQ ID NO: 1090 - DNA, 25 bp, Artificial sequence
  Synthetic sequence: Probe suitable for detection of genetic variations associated with adverse reactions to pharmaceuticals
gccaaccactccagtgggtgatggg

SEQ ID NO: 1091 - DNA, 25 bp, Artificial sequence
  Synthetic sequence: Probe suitable for detection of genetic variations associated with adverse reactions to pharmaceuticals
cccatcacccaccggagtggttggc

SEQ ID NO: 1092 - DNA, 25 bp, Artificial sequence
  Synthetic sequence: Probe suitable for detection of genetic variations associated with adverse reactions to pharmaceuticals
cccatcacccactggagtggttggc

SEQ ID NO: 1093 - DNA, 25 bp, Artificial sequence
  Synthetic sequence: Probe suitable for detection of genetic variations associated with adverse reactions to pharmaceuticals
gccaaccactccggtgggtgatggg

SEQ ID NO: 1094 - DNA, 25 bp, Artificial sequence
  Synthetic sequence: Probe suitable for detection of genetic variations associated with adverse reactions to pharmaceuticals
gccaaccactcctgtgggtgatggg

SEQ ID NO: 1095 - DNA, 25 bp, Artificial sequence
  Synthetic sequence: Probe suitable for detection of genetic variations associated with adverse reactions to pharmaceuticals
cccatcacccaccggagtggttggc

SEQ ID NO: 1096 - DNA, 25 bp, Artificial sequence
  Synthetic sequence: Probe suitable for detection of genetic variations associated with adverse reactions to pharmaceuticals
cccatcacccacaggagtggttggc

SEQ ID NO: 1097 - DNA, 25 bp, Artificial sequence
  Synthetic sequence: Probe suitable for detection of genetic variations associated with adverse reactions to pharmaceuticals
ccctttcgccccaacggtctcttgg

SEQ ID NO: 1098 - DNA, 25 bp, Artificial sequence
  Synthetic sequence: Probe suitable for detection of genetic variations associated with adverse reactions to pharmaceuticals
ccctttcgcccctttcgccccaacg

SEQ ID NO: 1099 - DNA, 25 bp, Artificial sequence
  Synthetic sequence: Probe suitable for detection of genetic variations associated with adverse reactions to pharmaceuticals
ccaagagaccgttggggcgaaaggg

SEQ ID NO: 1100 - DNA, 25 bp, Artificial sequence
  Synthetic sequence: Probe suitable for detection of genetic variations associated with adverse reactions to pharmaceuticals
cgttggggcgaaaggggcgaaaggg

SEQ ID NO: 1101 - DNA, 25 bp, Artificial sequence
  Synthetic sequence: Probe suitable for detection of genetic variations associated with adverse reactions to pharmaceuticals
acctagctcaggagggactgaagga

SEQ ID NO: 1102 - DNA, 25 bp, Artificial sequence
  Synthetic sequence: Probe suitable for detection of genetic variations associated with adverse reactions to pharmaceuticals
acctagctcagggagggactgaagg

SEQ ID NO: 1103 - DNA, 25 bp, Artificial sequence
  Synthetic sequence: Probe suitable for detection of genetic variations associated with adverse reactions to pharmaceuticals
tccttcagtccctcctgagctaggt

SEQ ID NO: 1104 - DNA, 25 bp, Artificial sequence
  Synthetic sequence: Probe suitable for detection of genetic variations associated with adverse reactions to pharmaceuticals
ccttcagtccctccctgagctaggt

SEQ ID NO: 1105 - DNA, 25 bp, Artificial sequence
  Synthetic sequence: Probe suitable for detection of genetic variations associated with adverse reactions to pharmaceuticals
ggatgagctgctaactgagcacagg

SEQ ID NO: 1106 - DNA, 25 bp, Artificial sequence
  Synthetic sequence: Probe suitable for detection of genetic variations associated with adverse reactions to pharmaceuticals
ggatgagctgctgagcacaggatga

SEQ ID NO: 1107 - DNA, 25 bp, Artificial sequence
  Synthetic sequence: Probe suitable for detection of genetic variations associated with adverse reactions to pharmaceuticals
cctgtgctcagttagcagctcatcc

SEQ ID NO: 1108 - DNA, 25 bp, Artificial sequence
  Synthetic sequence: Probe suitable for detection of genetic variations associated with adverse reactions to pharmaceuticals
tcatcctgtgctcagcagctcatcc

SEQ ID NO: 1109 - DNA, 25 bp, Artificial sequence
  Synthetic sequence: Probe suitable for detection of genetic variations associated with adverse reactions to pharmaceuticals
ctaactgagcacaggatgacctggg

SEQ ID NO: 1110 - DNA, 25 bp, Artificial sequence
  Synthetic sequence: Probe suitable for detection of genetic variations associated with adverse reactions to pharmaceuticals
ctaactgagcacggatgacctggga

SEQ ID NO: 1111 - DNA, 25 bp, Artificial sequence
  Synthetic sequence: Probe suitable for detection of genetic variations associated with adverse reactions to pharmaceuticals
cccaggtcatcctgtgctcagttag

SEQ ID NO: 1112 - DNA, 25 bp, Artificial sequence
  Synthetic sequence: Probe suitable for detection of genetic variations associated with adverse reactions to pharmaceuticals
tcccaggtcatccgtgctcagttag

SEQ ID NO: 1113 - DNA, 25 bp, Artificial sequence
  Synthetic sequence: Probe suitable for detection of genetic variations associated with adverse reactions to pharmaceuticals
tggcagagatggagaaggtgagagt

SEQ ID NO: 1114 - DNA, 25 bp, Artificial sequence
  Synthetic sequence: Probe suitable for detection of genetic variations associated with adverse reactions to pharmaceuticals
tggcagagatggaggtgagagtggc

SEQ ID NO: 1115 - DNA, 25 bp, Artificial sequence
  Synthetic sequence: Probe suitable for detection of genetic variations associated with adverse reactions to pharmaceuticals
actctcaccttctccatctctgcca

SEQ ID NO: 1116 - DNA, 25 bp, Artificial sequence
  Synthetic sequence: Probe suitable for detection of genetic variations associated with adverse reactions to pharmaceuticals
gccactctcacctccatctctgcca

SEQ ID NO: 1117 - DNA, 25 bp, Artificial sequence
  Synthetic sequence: Probe suitable for detection of genetic variations associated with adverse reactions to pharmaceuticals
gatgagaacctgcgcatagtggtgg

SEQ ID NO: 1118 - DNA, 25 bp, Artificial sequence
  Synthetic sequence: Probe suitable for detection of genetic variations associated with adverse reactions to pharmaceuticals
gatgagaacctgtgcatagtggtgg

SEQ ID NO: 1119 - DNA, 25 bp, Artificial sequence
  Synthetic sequence: Probe suitable for detection of genetic variations associated with adverse reactions to pharmaceuticals
ccaccactatgcgcaggttctcatc

SEQ ID NO: 1120 - DNA, 25 bp, Artificial sequence
  Synthetic sequence: Probe suitable for detection of genetic variations associated with adverse reactions to pharmaceuticals
ccaccactatgcacaggttctcatc

SEQ ID NO: 1121 - DNA, 25 bp, Artificial sequence
  Synthetic sequence: Probe suitable for detection of genetic variations associated with adverse reactions to pharmaceuticals
gagatcgacgacgtgatagggcagg

SEQ ID NO: 1122 - DNA, 25 bp, Artificial sequence
  Synthetic sequence: Probe suitable for detection of genetic variations associated with adverse reactions to pharmaceuticals
gagatcgacgacatgatagggcagg

SEQ ID NO: 1123 - DNA, 25 bp, Artificial sequence
  Synthetic sequence: Probe suitable for detection of genetic variations associated with adverse reactions to pharmaceuticals
cctgccctatcacgtcgtcgatctc

SEQ ID NO: 1124 - DNA, 25 bp, Artificial sequence
  Synthetic sequence: Probe suitable for detection of genetic variations associated with adverse reactions to pharmaceuticals
cctgccctatcatgtcgtcgatctc

SEQ ID NO: 1125 - DNA, 25 bp, Artificial sequence
  Synthetic sequence: Probe suitable for detection of genetic variations associated with adverse reactions to pharmaceuticals
atagggcaggtgcggcgaccagaga

SEQ ID NO: 1126 - DNA, 25 bp, Artificial sequence
  Synthetic sequence: Probe suitable for detection of genetic variations associated with adverse reactions to pharmaceuticals
atagggcaggtggggcgaccagaga

SEQ ID NO: 1127 - DNA, 25 bp, Artificial sequence
  Synthetic sequence: Probe suitable for detection of genetic variations associated with adverse reactions to pharmaceuticals
tctctggtcgccgcacctgccctat

SEQ ID NO: 1128 - DNA, 25 bp, Artificial sequence
  Synthetic sequence: Probe suitable for detection of genetic variations associated with adverse reactions to pharmaceuticals
tctctggtcgccccacctgccctat

SEQ ID NO: 1129 - DNA, 25 bp, Artificial sequence
  Synthetic sequence: Probe suitable for detection of genetic variations associated with adverse reactions to pharmaceuticals
gctttggggacatcgtccccctggg

SEQ ID NO: 1130 - DNA, 25 bp, Artificial sequence
  Synthetic sequence: Probe suitable for detection of genetic variations associated with adverse reactions to pharmaceuticals
gctttggggacaccgtccccctggg

SEQ ID NO: 1131 - DNA, 25 bp, Artificial sequence
  Synthetic sequence: Probe suitable for detection of genetic variations associated with adverse reactions to pharmaceuticals
cccagggggacgatgtccccaaagc

SEQ ID NO: 1132 - DNA, 25 bp, Artificial sequence
  Synthetic sequence: Probe suitable for detection of genetic variations associated with adverse reactions to pharmaceuticals
cccagggggacggtgtccccaaagc

SEQ ID NO: 1133 - DNA, 25 bp, Artificial sequence
  Synthetic sequence: Probe suitable for detection of genetic variations associated with adverse reactions to pharmaceuticals
tccccacaggccgccgtgcatgcct

SEQ ID NO: 1134 - DNA, 25 bp, Artificial sequence
  Synthetic sequence: Probe suitable for detection of genetic variations associated with adverse reactions to pharmaceuticals
tccccacaggccaccgtgcatgcct

SEQ ID NO: 1135 - DNA, 25 bp, Artificial sequence
  Synthetic sequence: Probe suitable for detection of genetic variations associated with adverse reactions to pharmaceuticals
aggcatgcacggcggcctgtgggga

SEQ ID NO: 1136 - DNA, 25 bp, Artificial sequence
  Synthetic sequence: Probe suitable for detection of genetic variations associated with adverse reactions to pharmaceuticals
aggcatgcacggtggcctgtgggga

SEQ ID NO: 1137 - DNA, 25 bp, Artificial sequence
  Synthetic sequence: Probe suitable for detection of genetic variations associated with adverse reactions to pharmaceuticals
tcggtgcccactggacagccccggc

SEQ ID NO: 1138 - DNA, 25 bp, Artificial sequence
  Synthetic sequence: Probe suitable for detection of genetic variations associated with adverse reactions to pharmaceuticals
tcggtgcccactgtgcccactggac

SEQ ID NO: 1139 - DNA, 25 bp, Artificial sequence
  Synthetic sequence: Probe suitable for detection of genetic variations associated with adverse reactions to pharmaceuticals
gccggggctgtccagtgggcaccga

SEQ ID NO: 1140 - DNA, 25 bp, Artificial sequence
  Synthetic sequence: Probe suitable for detection of genetic variations associated with adverse reactions to pharmaceuticals
gtccagtgggcacagtgggcaccga

SEQ ID NO: 1141 - DNA, 25 bp, Artificial sequence
  Synthetic sequence: Probe suitable for detection of genetic variations associated with adverse reactions to pharmaceuticals
gattgcttcctgatcaaaatggagc

SEQ ID NO: 1142 - DNA, 25 bp, Artificial sequence
  Synthetic sequence: Probe suitable for detection of genetic variations associated with adverse reactions to pharmaceuticals
gattgcttcctgttcaaaatggagc

SEQ ID NO: 1143 - DNA, 25 bp, Artificial sequence
  Synthetic sequence: Probe suitable for detection of genetic variations associated with adverse reactions to pharmaceuticals
gctccattttgatcaggaagcaatc

SEQ ID NO: 1144 - DNA, 25 bp, Artificial sequence
  Synthetic sequence: Probe suitable for detection of genetic variations associated with adverse reactions to pharmaceuticals
gctccattttgaacaggaagcaatc

SEQ ID NO: 1145 - DNA, 25 bp, Artificial sequence
  Synthetic sequence: Probe suitable for detection of genetic variations associated with adverse reactions to pharmaceuticals
ggatggggaagaggagcattgagga

SEQ ID NO: 1146 - DNA, 25 bp, Artificial sequence
  Synthetic sequence: Probe suitable for detection of genetic variations associated with adverse reactions to pharmaceuticals
ggatggggaagaagagcattgagga

SEQ ID NO: 1147 - DNA, 25 bp, Artificial sequence
  Synthetic sequence: Probe suitable for detection of genetic variations associated with adverse reactions to pharmaceuticals
tcctcaatgctcctcttccccatcc

SEQ ID NO: 1148 - DNA, 25 bp, Artificial sequence
  Synthetic sequence: Probe suitable for detection of genetic variations associated with adverse reactions to pharmaceuticals
tcctcaatgctcttcttccccatcc

SEQ ID NO: 1149 - DNA, 25 bp, Artificial sequence
  Synthetic sequence: Probe suitable for detection of genetic variations associated with adverse reactions to pharmaceuticals
ttaggaaattctttgtcatcatgta

SEQ ID NO: 1150 - DNA, 25 bp, Artificial sequence
  Synthetic sequence: Probe suitable for detection of genetic variations associated with adverse reactions to pharmaceuticals
ttaggaaattctctgtcatcatgta

SEQ ID NO: 1151 - DNA, 25 bp, Artificial sequence
  Synthetic sequence: Probe suitable for detection of genetic variations associated with adverse reactions to pharmaceuticals
tacatgatgacaaagaatttcctaa

SEQ ID NO: 1152 - DNA, 25 bp, Artificial sequence
  Synthetic sequence: Probe suitable for detection of genetic variations associated with adverse reactions to pharmaceuticals
tacatgatgacagagaatttcctaa

SEQ ID NO: 1153 - DNA, 25 bp, Artificial sequence
  Synthetic sequence: Probe suitable for detection of genetic variations associated with adverse reactions to pharmaceuticals
tcgggactttatcgattgcttcctg

SEQ ID NO: 1154 - DNA, 25 bp, Artificial sequence
  Synthetic sequence: Probe suitable for detection of genetic variations associated with adverse reactions to pharmaceuticals
tcgggactttatggattgcttcctg

SEQ ID NO: 1155 - DNA, 25 bp, Artificial sequence
  Synthetic sequence: Probe suitable for detection of genetic variations associated with adverse reactions to pharmaceuticals
caggaagcaatcgataaagtcccga

SEQ ID NO: 1156 - DNA, 25 bp, Artificial sequence
  Synthetic sequence: Probe suitable for detection of genetic variations associated with adverse reactions to pharmaceuticals
caggaagcaatccataaagtcccga

SEQ ID NO: 1157 - DNA, 25 bp, Artificial sequence
  Synthetic sequence: Probe suitable for detection of genetic variations associated with adverse reactions to pharmaceuticals
tgcaggtgaccattgacggcaggaa

SEQ ID NO: 1158 - DNA, 25 bp, Artificial sequence
  Synthetic sequence: Probe suitable for detection of genetic variations associated with adverse reactions to pharmaceuticals
tgcaggtgaccactgacggcaggaa

SEQ ID NO: 1159 - DNA, 25 bp, Artificial sequence
  Synthetic sequence: Probe suitable for detection of genetic variations associated with adverse reactions to pharmaceuticals
ttcctgccgtcaatggtcacctgca

SEQ ID NO: 1160 - DNA, 25 bp, Artificial sequence
  Synthetic sequence: Probe suitable for detection of genetic variations associated with adverse reactions to pharmaceuticals
ttcctgccgtcagtggtcacctgca

SEQ ID NO: 1161 - DNA, 25 bp, Artificial sequence
  Synthetic sequence: Probe suitable for detection of genetic variations associated with adverse reactions to pharmaceuticals
ggaatctggtacctggaccaaatca

SEQ ID NO: 1162 - DNA, 25 bp, Artificial sequence
  Synthetic sequence: Probe suitable for detection of genetic variations associated with adverse reactions to pharmaceuticals
ggaatctggtacttggaccaaatca

SEQ ID NO: 1163 - DNA, 25 bp, Artificial sequence
  Synthetic sequence: Probe suitable for detection of genetic variations associated with adverse reactions to pharmaceuticals
tgatttggtccaggtaccagattcc

SEQ ID NO: 1164 - DNA, 25 bp, Artificial sequence
  Synthetic sequence: Probe suitable for detection of genetic variations associated with adverse reactions to pharmaceuticals
tgatttggtccaagtaccagattcc

SEQ ID NO: 1165 - DNA, 25 bp, Artificial sequence
  Synthetic sequence: Probe suitable for detection of genetic variations associated with adverse reactions to pharmaceuticals
aagaagtgctgaaaaatatatttaa

SEQ ID NO: 1166 - DNA, 25 bp, Artificial sequence
  Synthetic sequence: Probe suitable for detection of genetic variations associated with adverse reactions to pharmaceuticals
aagaagtgctgagaaatatatttaa

SEQ ID NO: 1167 - DNA, 25 bp, Artificial sequence
  Synthetic sequence: Probe suitable for detection of genetic variations associated with adverse reactions to pharmaceuticals
ttaaatatatttttcagcacttctt

SEQ ID NO: 1168 - DNA, 25 bp, Artificial sequence
  Synthetic sequence: Probe suitable for detection of genetic variations associated with adverse reactions to pharmaceuticals
ttaaatatatttctcagcacttctt

SEQ ID NO: 1169 - DNA, 25 bp, Artificial sequence
  Synthetic sequence: Probe suitable for detection of genetic variations associated with adverse reactions to pharmaceuticals
agggtatttttacatccctccagtt

SEQ ID NO: 1170 - DNA, 25 bp, Artificial sequence
  Synthetic sequence: Probe suitable for detection of genetic variations associated with adverse reactions to pharmaceuticals
agggtatttttatatccctccagtt

SEQ ID NO: 1171 - DNA, 25 bp, Artificial sequence
  Synthetic sequence: Probe suitable for detection of genetic variations associated with adverse reactions to pharmaceuticals
aactggagggatgtaaaaataccct

SEQ ID NO: 1172 - DNA, 25 bp, Artificial sequence
  Synthetic sequence: Probe suitable for detection of genetic variations associated with adverse reactions to pharmaceuticals
aactggagggatataaaaataccct

SEQ ID NO: 1173 - DNA, 25 bp, Artificial sequence
  Synthetic sequence: Probe suitable for detection of genetic variations associated with adverse reactions to pharmaceuticals
cgcttgaacctcgaacaattgaaga

SEQ ID NO: 1174 - DNA, 25 bp, Artificial sequence
  Synthetic sequence: Probe suitable for detection of genetic variations associated with adverse reactions to pharmaceuticals
cgcttgaacctcaaacaattgaaga

SEQ ID NO: 1175 - DNA, 25 bp, Artificial sequence
  Synthetic sequence: Probe suitable for detection of genetic variations associated with adverse reactions to pharmaceuticals
tcttcaattgttcgaggttcaagcg

SEQ ID NO: 1176 - DNA, 25 bp, Artificial sequence
  Synthetic sequence: Probe suitable for detection of genetic variations associated with adverse reactions to pharmaceuticals
tcttcaattgtttgaggttcaagcg

SEQ ID NO: 1177 - DNA, 25 bp, Artificial sequence
  Synthetic sequence: Probe suitable for detection of genetic variations associated with adverse reactions to pharmaceuticals
aacctggtgatggatcccttactat

SEQ ID NO: 1178 - DNA, 25 bp, Artificial sequence
  Synthetic sequence: Probe suitable for detection of genetic variations associated with adverse reactions to pharmaceuticals
aacctggtgatgaatcccttactat

SEQ ID NO: 1179 - DNA, 25 bp, Artificial sequence
  Synthetic sequence: Probe suitable for detection of genetic variations associated with adverse reactions to pharmaceuticals
atagtaagggatccatcaccaggtt

SEQ ID NO: 1180 - DNA, 25 bp, Artificial sequence
  Synthetic sequence: Probe suitable for detection of genetic variations associated with adverse reactions to pharmaceuticals
atagtaagggattcatcaccaggtt

SEQ ID NO: 1181 - DNA, 25 bp, Artificial sequence
  Synthetic sequence: Probe suitable for detection of genetic variations associated with adverse reactions to pharmaceuticals
taagaagaaaccggggtgggtggtg

SEQ ID NO: 1182 - DNA, 25 bp, Artificial sequence
  Synthetic sequence: Probe suitable for detection of genetic variations associated with adverse reactions to pharmaceuticals
taagaagaaaccagggtgggtggtg

SEQ ID NO: 1183 - DNA, 25 bp, Artificial sequence
  Synthetic sequence: Probe suitable for detection of genetic variations associated with adverse reactions to pharmaceuticals
caccacccaccccggtttcttctta

SEQ ID NO: 1184 - DNA, 25 bp, Artificial sequence
  Synthetic sequence: Probe suitable for detection of genetic variations associated with adverse reactions to pharmaceuticals
caccacccaccctggtttcttctta

SEQ ID NO: 1185 - DNA, 25 bp, Artificial sequence
  Synthetic sequence: Probe suitable for detection of genetic variations associated with adverse reactions to pharmaceuticals
aagcaccccctggatccaggtaagg

SEQ ID NO: 1186 - DNA, 25 bp, Artificial sequence
  Synthetic sequence: Probe suitable for detection of genetic variations associated with adverse reactions to pharmaceuticals
aagcaccccctgaatccaggtaagg

SEQ ID NO: 1187 - DNA, 25 bp, Artificial sequence
  Synthetic sequence: Probe suitable for detection of genetic variations associated with adverse reactions to pharmaceuticals
ccttacctggatccagggggtgctt

SEQ ID NO: 1188 - DNA, 25 bp, Artificial sequence
  Synthetic sequence: Probe suitable for detection of genetic variations associated with adverse reactions to pharmaceuticals
ccttacctggattcagggggtgctt

SEQ ID NO: 1189 - DNA, 25 bp, Artificial sequence
  Synthetic sequence: Probe suitable for detection of genetic variations associated with adverse reactions to pharmaceuticals
tgattatttcccgggaacccataac

SEQ ID NO: 1190 - DNA, 25 bp, Artificial sequence
  Synthetic sequence: Probe suitable for detection of genetic variations associated with adverse reactions to pharmaceuticals
tgattatttcccaggaacccataac

SEQ ID NO: 1191 - DNA, 25 bp, Artificial sequence
  Synthetic sequence: Probe suitable for detection of genetic variations associated with adverse reactions to pharmaceuticals
gttatgggttcccgggaaataatca

SEQ ID NO: 1192 - DNA, 25 bp, Artificial sequence
  Synthetic sequence: Probe suitable for detection of genetic variations associated with adverse reactions to pharmaceuticals
gttatgggttcctgggaaataatca

SEQ ID NO: 1193 - DNA, 25 bp, Artificial sequence
  Synthetic sequence: Probe suitable for detection of genetic variations associated with adverse reactions to pharmaceuticals
ttgattatttcccgggaacccataa

SEQ ID NO: 1194 - DNA, 25 bp, Artificial sequence
  Synthetic sequence: Probe suitable for detection of genetic variations associated with adverse reactions to pharmaceuticals
ttgattatttcctgggaacccataa

SEQ ID NO: 1195 - DNA, 25 bp, Artificial sequence
  Synthetic sequence: Probe suitable for detection of genetic variations associated with adverse reactions to pharmaceuticals
ttatgggttcccgggaaataatcaa

SEQ ID NO: 1196 - DNA, 25 bp, Artificial sequence
  Synthetic sequence: Probe suitable for detection of genetic variations associated with adverse reactions to pharmaceuticals
ttatgggttcccaggaaataatcaa

SEQ ID NO: 1197 - DNA, 25 bp, Artificial sequence
  Synthetic sequence: Probe suitable for detection of genetic variations associated with adverse reactions to pharmaceuticals
gagaaggcttcaatggatccttttg

SEQ ID NO: 1198 - DNA, 25 bp, Artificial sequence
  Synthetic sequence: Probe suitable for detection of genetic variations associated with adverse reactions to pharmaceuticals
gagaaggcttcagtggatccttttg

SEQ ID NO: 1199 - DNA, 25 bp, Artificial sequence
  Synthetic sequence: Probe suitable for detection of genetic variations associated with adverse reactions to pharmaceuticals
caaaaggatccattgaagccttctc

SEQ ID NO: 1200 - DNA, 25 bp, Artificial sequence
  Synthetic sequence: Probe suitable for detection of genetic variations associated with adverse reactions to pharmaceuticals
caaaaggatccactgaagccttctc

SEQ ID NO: 1201 - DNA, 25 bp, Artificial sequence
  Synthetic sequence: Probe suitable for detection of genetic variations associated with adverse reactions to pharmaceuticals
aaatggagaaggtaaaatgttaaca

SEQ ID NO: 1202 - DNA, 25 bp, Artificial sequence
  Synthetic sequence: Probe suitable for detection of genetic variations associated with adverse reactions to pharmaceuticals
aaatggagaaggaaaaatgttaaca

SEQ ID NO: 1203 - DNA, 25 bp, Artificial sequence
  Synthetic sequence: Probe suitable for detection of genetic variations associated with adverse reactions to pharmaceuticals
tgttaacattttaccttctccattt

SEQ ID NO: 1204 - DNA, 25 bp, Artificial sequence
  Synthetic sequence: Probe suitable for detection of genetic variations associated with adverse reactions to pharmaceuticals
tgttaacatttttccttctccattt

SEQ ID NO: 1205 - DNA, 25 bp, Artificial sequence
  Synthetic sequence: Probe suitable for detection of genetic variations associated with adverse reactions to pharmaceuticals
aatggaaagagatggaaggagatcc

SEQ ID NO: 1206 - DNA, 25 bp, Artificial sequence
  Synthetic sequence: Probe suitable for detection of genetic variations associated with adverse reactions to pharmaceuticals
aatggaaagagacggaaggagatcc

SEQ ID NO: 1207 - DNA, 25 bp, Artificial sequence
  Synthetic sequence: Probe suitable for detection of genetic variations associated with adverse reactions to pharmaceuticals
ggatctccttccatctctttccatt

SEQ ID NO: 1208 - DNA, 25 bp, Artificial sequence
  Synthetic sequence: Probe suitable for detection of genetic variations associated with adverse reactions to pharmaceuticals
ggatctccttccgtctctttccatt

SEQ ID NO: 1209 - DNA, 25 bp, Artificial sequence
  Synthetic sequence: Probe suitable for detection of genetic variations associated with adverse reactions to pharmaceuticals
gcattgaggaccgtgttcaagagga

SEQ ID NO: 1210 - DNA, 25 bp, Artificial sequence
  Synthetic sequence: Probe suitable for detection of genetic variations associated with adverse reactions to pharmaceuticals
gcattgaggaccatgttcaagagga

SEQ ID NO: 1211 - DNA, 25 bp, Artificial sequence
  Synthetic sequence: Probe suitable for detection of genetic variations associated with adverse reactions to pharmaceuticals
tcctcttgaacacggtcctcaatgc

SEQ ID NO: 1212 - DNA, 25 bp, Artificial sequence
  Synthetic sequence: Probe suitable for detection of genetic variations associated with adverse reactions to pharmaceuticals
tcctcttgaacatggtcctcaatgc

SEQ ID NO: 1213 - DNA, 25 bp, Artificial sequence
  Synthetic sequence: Probe suitable for detection of genetic variations associated with adverse reactions to pharmaceuticals
ttttcaggaaaacggatttgtgtgg

SEQ ID NO: 1214 - DNA, 25 bp, Artificial sequence
  Synthetic sequence: Probe suitable for detection of genetic variations associated with adverse reactions to pharmaceuticals
ttttcaggaaaatggatttgtgtgg

SEQ ID NO: 1215 - DNA, 25 bp, Artificial sequence
  Synthetic sequence: Probe suitable for detection of genetic variations associated with adverse reactions to pharmaceuticals
ccacacaaatccgttttcctgaaaa

SEQ ID NO: 1216 - DNA, 25 bp, Artificial sequence
  Synthetic sequence: Probe suitable for detection of genetic variations associated with adverse reactions to pharmaceuticals
ccacacaaatccattttcctgaaaa

SEQ ID NO: 1217 - DNA, 25 bp, Artificial sequence
  Synthetic sequence: Probe suitable for detection of genetic variations associated with adverse reactions to pharmaceuticals
gttcatggttgcggtgggggagttc

SEQ ID NO: 1218 - DNA, 25 bp, Artificial sequence
  Synthetic sequence: Probe suitable for detection of genetic variations associated with adverse reactions to pharmaceuticals
gttcatggttgcagtgggggagttc

SEQ ID NO: 1219 - DNA, 25 bp, Artificial sequence
  Synthetic sequence: Probe suitable for detection of genetic variations associated with adverse reactions to pharmaceuticals
gaactcccccaccgcaaccatgaac

SEQ ID NO: 1220 - DNA, 25 bp, Artificial sequence
  Synthetic sequence: Probe suitable for detection of genetic variations associated with adverse reactions to pharmaceuticals
gaactcccccactgcaaccatgaac

SEQ ID NO: 1221 - DNA, 25 bp, Artificial sequence
  Synthetic sequence: Probe suitable for detection of genetic variations associated with adverse reactions to pharmaceuticals
tgctgccctcacaatctcttcctgt

SEQ ID NO: 1222 - DNA, 25 bp, Artificial sequence
  Synthetic sequence: Probe suitable for detection of genetic variations associated with adverse reactions to pharmaceuticals
tgctgccctcacgatctcttcctgt

SEQ ID NO: 1223 - DNA, 25 bp, Artificial sequence
  Synthetic sequence: Probe suitable for detection of genetic variations associated with adverse reactions to pharmaceuticals
acaggaagagattgtgagggcagca

SEQ ID NO: 1224 - DNA, 25 bp, Artificial sequence
  Synthetic sequence: Probe suitable for detection of genetic variations associated with adverse reactions to pharmaceuticals
acaggaagagatcgtgagggcagca

SEQ ID NO: 1225 - DNA, 25 bp, Artificial sequence
  Synthetic sequence: Probe suitable for detection of genetic variations associated with adverse reactions to pharmaceuticals
ttgaaaagttatatctacttacaga

SEQ ID NO: 1226 - DNA, 25 bp, Artificial sequence
  Synthetic sequence: Probe suitable for detection of genetic variations associated with adverse reactions to pharmaceuticals
ttgaaaagttatgtctacttacaga

SEQ ID NO: 1227 - DNA, 25 bp, Artificial sequence
  Synthetic sequence: Probe suitable for detection of genetic variations associated with adverse reactions to pharmaceuticals
tctgtaagtagatataacttttcaa

SEQ ID NO: 1228 - DNA, 25 bp, Artificial sequence
  Synthetic sequence: Probe suitable for detection of genetic variations associated with adverse reactions to pharmaceuticals
tctgtaagtagacataacttttcaa

SEQ ID NO: 1229 - DNA, 25 bp, Artificial sequence
  Synthetic sequence: Probe suitable for detection of genetic variations associated with adverse reactions to pharmaceuticals
gtccccggtctggaaacctgcataa

SEQ ID NO: 1230 - DNA, 25 bp, Artificial sequence
  Synthetic sequence: Probe suitable for detection of genetic variations associated with adverse reactions to pharmaceuticals
gtccccggtctgcaaacctgcataa

SEQ ID NO: 1231 - DNA, 25 bp, Artificial sequence
  Synthetic sequence: Probe suitable for detection of genetic variations associated with adverse reactions to pharmaceuticals
ttatgcaggtttccagaccggggac

SEQ ID NO: 1232 - DNA, 25 bp, Artificial sequence
  Synthetic sequence: Probe suitable for detection of genetic variations associated with adverse reactions to pharmaceuticals
ttatgcaggtttgcagaccggggac

SEQ ID NO: 1233 - DNA, 25 bp, Artificial sequence
  Synthetic sequence: Probe suitable for detection of genetic variations associated with adverse reactions to pharmaceuticals
tgtctgcgggagccgatttcatcat

SEQ ID NO: 1234 - DNA, 25 bp, Artificial sequence
  Synthetic sequence: Probe suitable for detection of genetic variations associated with adverse reactions to pharmaceuticals
tgtctgcgggagtcgatttcatcat

SEQ ID NO: 1235 - DNA, 25 bp, Artificial sequence
  Synthetic sequence: Probe suitable for detection of genetic variations associated with adverse reactions to pharmaceuticals
atgatgaaatcggctcccgcagaca

SEQ ID NO: 1236 - DNA, 25 bp, Artificial sequence
  Synthetic sequence: Probe suitable for detection of genetic variations associated with adverse reactions to pharmaceuticals
atgatgaaatcgactcccgcagaca

SEQ ID NO: 1237 - DNA, 25 bp, Artificial sequence
  Synthetic sequence: Probe suitable for detection of genetic variations associated with adverse reactions to pharmaceuticals
gtcagaacatagatcaaagttttcc

SEQ ID NO: 1238 - DNA, 25 bp, Artificial sequence
  Synthetic sequence: Probe suitable for detection of genetic variations associated with adverse reactions to pharmaceuticals
gtcagaacataggtcaaagttttcc

SEQ ID NO: 1239 - DNA, 25 bp, Artificial sequence
  Synthetic sequence: Probe suitable for detection of genetic variations associated with adverse reactions to pharmaceuticals
ggaaaactttgatctatgttctgac

SEQ ID NO: 1240 - DNA, 25 bp, Artificial sequence
  Synthetic sequence: Probe suitable for detection of genetic variations associated with adverse reactions to pharmaceuticals
ggaaaactttgacctatgttctgac

SEQ ID NO: 1241 - DNA, 25 bp, Artificial sequence
  Synthetic sequence: Probe suitable for detection of genetic variations associated with adverse reactions to pharmaceuticals
aatattgatgaagcagaatgggagt

SEQ ID NO: 1242 - DNA, 25 bp, Artificial sequence
  Synthetic sequence: Probe suitable for detection of genetic variations associated with adverse reactions to pharmaceuticals
aatattgatgaaacagaatgggagt

SEQ ID NO: 1243 - DNA, 25 bp, Artificial sequence
  Synthetic sequence: Probe suitable for detection of genetic variations associated with adverse reactions to pharmaceuticals
actcccattctgcttcatcaatatt

SEQ ID NO: 1244 - DNA, 25 bp, Artificial sequence
  Synthetic sequence: Probe suitable for detection of genetic variations associated with adverse reactions to pharmaceuticals
actcccattctgtttcatcaatatt

SEQ ID NO: 1245 - DNA, 25 bp, Artificial sequence
  Synthetic sequence: Probe suitable for detection of genetic variations associated with adverse reactions to pharmaceuticals
gagacaagggcaagagagaggcgat

SEQ ID NO: 1246 - DNA, 25 bp, Artificial sequence
  Synthetic sequence: Probe suitable for detection of genetic variations associated with adverse reactions to pharmaceuticals
gagacaagggcaggagagaggcgat

SEQ ID NO: 1247 - DNA, 25 bp, Artificial sequence
  Synthetic sequence: Probe suitable for detection of genetic variations associated with adverse reactions to pharmaceuticals
atcgcctctctcttgcccttgtctc

SEQ ID NO: 1248 - DNA, 25 bp, Artificial sequence
  Synthetic sequence: Probe suitable for detection of genetic variations associated with adverse reactions to pharmaceuticals
atcgcctctctcctgcccttgtctc

SEQ ID NO: 1249 - DNA, 25 bp, Artificial sequence
  Synthetic sequence: Probe suitable for detection of genetic variations associated with adverse reactions to pharmaceuticals
agctctgtgggcacaggacgcatgg

SEQ ID NO: 1250 - DNA, 25 bp, Artificial sequence
  Synthetic sequence: Probe suitable for detection of genetic variations associated with adverse reactions to pharmaceuticals
agctctgtgggcccaggacgcatgg

SEQ ID NO: 1251 - DNA, 25 bp, Artificial sequence
  Synthetic sequence: Probe suitable for detection of genetic variations associated with adverse reactions to pharmaceuticals
ccatgcgtcctgtgcccacagagct

SEQ ID NO: 1252 - DNA, 25 bp, Artificial sequence
  Synthetic sequence: Probe suitable for detection of genetic variations associated with adverse reactions to pharmaceuticals
ccatgcgtcctgggcccacagagct

SEQ ID NO: 1253 - DNA, 25 bp, Artificial sequence
  Synthetic sequence: Probe suitable for detection of genetic variations associated with adverse reactions to pharmaceuticals
cctccgcctctcggattcaagcaat

SEQ ID NO: 1254 - DNA, 25 bp, Artificial sequence
  Synthetic sequence: Probe suitable for detection of genetic variations associated with adverse reactions to pharmaceuticals
cctccgcctctcagattcaagcaat

SEQ ID NO: 1255 - DNA, 25 bp, Artificial sequence
  Synthetic sequence: Probe suitable for detection of genetic variations associated with adverse reactions to pharmaceuticals
attgcttgaatccgagaggcggagg

SEQ ID NO: 1256 - DNA, 25 bp, Artificial sequence
  Synthetic sequence: Probe suitable for detection of genetic variations associated with adverse reactions to pharmaceuticals
attgcttgaatctgagaggcggagg

SEQ ID NO: 1257 - DNA, 25 bp, Artificial sequence
  Synthetic sequence: Probe suitable for detection of genetic variations associated with adverse reactions to pharmaceuticals
caaccatgacccgtgagtacatacc

SEQ ID NO: 1258 - DNA, 25 bp, Artificial sequence
  Synthetic sequence: Probe suitable for detection of genetic variations associated with adverse reactions to pharmaceuticals
caaccatgacccatgagtacatacc

SEQ ID NO: 1259 - DNA, 25 bp, Artificial sequence
  Synthetic sequence: Probe suitable for detection of genetic variations associated with adverse reactions to pharmaceuticals
ggtatgtactcacgggtcatggttg

SEQ ID NO: 1260 - DNA, 25 bp, Artificial sequence
  Synthetic sequence: Probe suitable for detection of genetic variations associated with adverse reactions to pharmaceuticals
ggtatgtactcatgggtcatggttg

SEQ ID NO: 1261 - DNA, 25 bp, Artificial sequence
  Synthetic sequence: Probe suitable for detection of genetic variations associated with adverse reactions to pharmaceuticals
gcctgggcacttcgacccttacaat

SEQ ID NO: 1262 - DNA, 25 bp, Artificial sequence
  Synthetic sequence: Probe suitable for detection of genetic variations associated with adverse reactions to pharmaceuticals
gcctgggcacttagacccttacaat

SEQ ID NO: 1263 - DNA, 25 bp, Artificial sequence
  Synthetic sequence: Probe suitable for detection of genetic variations associated with adverse reactions to pharmaceuticals
attgtaagggtcgaagtgcccaggc

SEQ ID NO: 1264 - DNA, 25 bp, Artificial sequence
  Synthetic sequence: Probe suitable for detection of genetic variations associated with adverse reactions to pharmaceuticals
attgtaagggtctaagtgcccaggc

SEQ ID NO: 1265 - DNA, 25 bp, Artificial sequence
  Synthetic sequence: Probe suitable for detection of genetic variations associated with adverse reactions to pharmaceuticals
ggagagcactaagaagttcctaaaa

SEQ ID NO: 1266 - DNA, 25 bp, Artificial sequence
  Synthetic sequence: Probe suitable for detection of genetic variations associated with adverse reactions to pharmaceuticals
ggagagcactaaaaagttcctaaaa

SEQ ID NO: 1267 - DNA, 25 bp, Artificial sequence
  Synthetic sequence: Probe suitable for detection of genetic variations associated with adverse reactions to pharmaceuticals
ttttaggaacttcttagtgctctcc

SEQ ID NO: 1268 - DNA, 25 bp, Artificial sequence
  Synthetic sequence: Probe suitable for detection of genetic variations associated with adverse reactions to pharmaceuticals
ttttaggaactttttagtgctctcc

SEQ ID NO: 1269 - DNA, 25 bp, Artificial sequence
  Synthetic sequence: Probe suitable for detection of genetic variations associated with adverse reactions to pharmaceuticals
agatatgggacccgtacacatggac

SEQ ID NO: 1270 - DNA, 25 bp, Artificial sequence
  Synthetic sequence: Probe suitable for detection of genetic variations associated with adverse reactions to pharmaceuticals
agatatgggacctgtacacatggac

SEQ ID NO: 1271 - DNA, 25 bp, Artificial sequence
  Synthetic sequence: Probe suitable for detection of genetic variations associated with adverse reactions to pharmaceuticals
gtccatgtgtacgggtcccatatct

SEQ ID NO: 1272 - DNA, 25 bp, Artificial sequence
  Synthetic sequence: Probe suitable for detection of genetic variations associated with adverse reactions to pharmaceuticals
gtccatgtgtacaggtcccatatct

SEQ ID NO: 1273 - DNA, 25 bp, Artificial sequence
  Synthetic sequence: Probe suitable for detection of genetic variations associated with adverse reactions to pharmaceuticals
aaggagattgatgcagttttgccca

SEQ ID NO: 1274 - DNA, 25 bp, Artificial sequence
  Synthetic sequence: Probe suitable for detection of genetic variations associated with adverse reactions to pharmaceuticals
aaggagattgatacagttttgccca

SEQ ID NO: 1275 - DNA, 25 bp, Artificial sequence
  Synthetic sequence: Probe suitable for detection of genetic variations associated with adverse reactions to pharmaceuticals
tgggcaaaactgcatcaatctcctt

SEQ ID NO: 1276 - DNA, 25 bp, Artificial sequence
  Synthetic sequence: Probe suitable for detection of genetic variations associated with adverse reactions to pharmaceuticals
tgggcaaaactgtatcaatctcctt

SEQ ID NO: 1277 - DNA, 25 bp, Artificial sequence
  Synthetic sequence: Probe suitable for detection of genetic variations associated with adverse reactions to pharmaceuticals
ttggcatgaggtttgctctcatgaa

SEQ ID NO: 1278 - DNA, 25 bp, Artificial sequence
  Synthetic sequence: Probe suitable for detection of genetic variations associated with adverse reactions to pharmaceuticals
ttggcatgaggtctgctctcatgaa

SEQ ID NO: 1279 - DNA, 25 bp, Artificial sequence
  Synthetic sequence: Probe suitable for detection of genetic variations associated with adverse reactions to pharmaceuticals
ttcatgagagcaaacctcatgccaa

SEQ ID NO: 1280 - DNA, 25 bp, Artificial sequence
  Synthetic sequence: Probe suitable for detection of genetic variations associated with adverse reactions to pharmaceuticals
ttcatgagagcagacctcatgccaa

SEQ ID NO: 1281 - DNA, 25 bp, Artificial sequence
  Synthetic sequence: Probe suitable for detection of genetic variations associated with adverse reactions to pharmaceuticals
ttttgtctttcagtatctcttccct

SEQ ID NO: 1282 - DNA, 25 bp, Artificial sequence
  Synthetic sequence: Probe suitable for detection of genetic variations associated with adverse reactions to pharmaceuticals
ttttgtctttcaatatctcttccct

SEQ ID NO: 1283 - DNA, 25 bp, Artificial sequence
  Synthetic sequence: Probe suitable for detection of genetic variations associated with adverse reactions to pharmaceuticals
agggaagagatactgaaagacaaaa

SEQ ID NO: 1284 - DNA, 25 bp, Artificial sequence
  Synthetic sequence: Probe suitable for detection of genetic variations associated with adverse reactions to pharmaceuticals
agggaagagatattgaaagacaaaa

SEQ ID NO: 1285 - DNA, 25 bp, Artificial sequence
  Synthetic sequence: Probe suitable for detection of genetic variations associated with adverse reactions to pharmaceuticals
atcccccctgcaccccccagcatcc

SEQ ID NO: 1286 - DNA, 25 bp, Artificial sequence
  Synthetic sequence: Probe suitable for detection of genetic variations associated with adverse reactions to pharmaceuticals
atcccccctgcacccccagcatccc

SEQ ID NO: 1287 - DNA, 25 bp, Artificial sequence
  Synthetic sequence: Probe suitable for detection of genetic variations associated with adverse reactions to pharmaceuticals
ggatgctggggggtgcaggggggat

SEQ ID NO: 1288 - DNA, 25 bp, Artificial sequence
  Synthetic sequence: Probe suitable for detection of genetic variations associated with adverse reactions to pharmaceuticals
gggatgctgggggtgcaggggggat

SEQ ID NO: 1289 - DNA, 25 bp, Artificial sequence
  Synthetic sequence: Probe suitable for detection of genetic variations associated with adverse reactions to pharmaceuticals
agggaaaagaagaggatacttctct

SEQ ID NO: 1290 - DNA, 25 bp, Artificial sequence
  Synthetic sequence: Probe suitable for detection of genetic variations associated with adverse reactions to pharmaceuticals
agggaaaagaagatacttctctatc

SEQ ID NO: 1291 - DNA, 25 bp, Artificial sequence
  Synthetic sequence: Probe suitable for detection of genetic variations associated with adverse reactions to pharmaceuticals
agagaagtatcctcttcttttccct

SEQ ID NO: 1292 - DNA, 25 bp, Artificial sequence
  Synthetic sequence: Probe suitable for detection of genetic variations associated with adverse reactions to pharmaceuticals
gatagagaagtatcttcttttccct

SEQ ID NO: 1293 - DNA, 25 bp, Artificial sequence
  Synthetic sequence: Probe suitable for detection of genetic variations associated with adverse reactions to pharmaceuticals
cacacattcttggccttctgcagat

SEQ ID NO: 1294 - DNA, 25 bp, Artificial sequence
  Synthetic sequence: Probe suitable for detection of genetic variations associated with adverse reactions to pharmaceuticals
cacacattcttgaccttctgcagat

SEQ ID NO: 1295 - DNA, 25 bp, Artificial sequence
  Synthetic sequence: Probe suitable for detection of genetic variations associated with adverse reactions to pharmaceuticals
atctgcagaaggccaagaatgtgtg

SEQ ID NO: 1296 - DNA, 25 bp, Artificial sequence
  Synthetic sequence: Probe suitable for detection of genetic variations associated with adverse reactions to pharmaceuticals
atctgcagaaggtcaagaatgtgtg

SEQ ID NO: 1297 - DNA, 25 bp, Artificial sequence
  Synthetic sequence: Probe suitable for detection of genetic variations associated with adverse reactions to pharmaceuticals
ctgcctagtgggttcacctgcccac

SEQ ID NO: 1298 - DNA, 25 bp, Artificial sequence
  Synthetic sequence: Probe suitable for detection of genetic variations associated with adverse reactions to pharmaceuticals
ctgcctagtggggtcacctgcccac

SEQ ID NO: 1299 - DNA, 25 bp, Artificial sequence
  Synthetic sequence: Probe suitable for detection of genetic variations associated with adverse reactions to pharmaceuticals
gtgggcaggtgaacccactaggcag

SEQ ID NO: 1300 - DNA, 25 bp, Artificial sequence
  Synthetic sequence: Probe suitable for detection of genetic variations associated with adverse reactions to pharmaceuticals
gtgggcaggtgaccccactaggcag

SEQ ID NO: 1301 - DNA, 25 bp, Artificial sequence
  Synthetic sequence: Probe suitable for detection of genetic variations associated with adverse reactions to pharmaceuticals
gacctgcagaagcgcctggcagtgt

SEQ ID NO: 1302 - DNA, 25 bp, Artificial sequence
  Synthetic sequence: Probe suitable for detection of genetic variations associated with adverse reactions to pharmaceuticals
acactgccaggcgcttctgcaggtc

SEQ ID NO: 1303 - DNA, 25 bp, Artificial sequence
  Synthetic sequence: Probe suitable for detection of genetic variations associated with adverse reactions to pharmaceuticals
gacctgcagaagtgcctggcagtgt

SEQ ID NO: 1304 - DNA, 25 bp, Artificial sequence
  Synthetic sequence: Probe suitable for detection of genetic variations associated with adverse reactions to pharmaceuticals
acactgccaggcacttctgcaggtc

SEQ ID NO: 1305 - DNA, 25 bp, Artificial sequence
  Synthetic sequence: Probe suitable for detection of genetic variations associated with adverse reactions to pharmaceuticals
atggaggacgtgtgcggccgcctgg

SEQ ID NO: 1306 - DNA, 25 bp, Artificial sequence
  Synthetic sequence: Probe suitable for detection of genetic variations associated with adverse reactions to pharmaceuticals
ccaggcggccgcacacgtcctccat

SEQ ID NO: 1307 - DNA, 25 bp, Artificial sequence
  Synthetic sequence: Probe suitable for detection of genetic variations associated with adverse reactions to pharmaceuticals
atggaggacgtgcgcggccgcctgg

SEQ ID NO: 1308 - DNA, 25 bp, Artificial sequence
  Synthetic sequence: Probe suitable for detection of genetic variations associated with adverse reactions to pharmaceuticals
ccaggcggccgcgcacgtcctccat

SEQ ID NO: 1309 - DNA, 25 bp, Artificial sequence
  Synthetic sequence: Probe suitable for detection of genetic variations associated with adverse reactions to pharmaceuticals
ttgaggggcatggggacggggttca

SEQ ID NO: 1310 - DNA, 25 bp, Artificial sequence
  Synthetic sequence: Probe suitable for detection of genetic variations associated with adverse reactions to pharmaceuticals
ttgaggggcatgaggacggggttca

SEQ ID NO: 1311 - DNA, 25 bp, Artificial sequence
  Synthetic sequence: Probe suitable for detection of genetic variations associated with adverse reactions to pharmaceuticals
tgaaccccgtccccatgcccctcaa

SEQ ID NO: 1312 - DNA, 25 bp, Artificial sequence
  Synthetic sequence: Probe suitable for detection of genetic variations associated with adverse reactions to pharmaceuticals
tgaaccccgtcctcatgcccctcaa

SEQ ID NO: 1313 - DNA, 25 bp, Artificial sequence
  Synthetic sequence: Probe suitable for detection of genetic variations associated with adverse reactions to pharmaceuticals
gcttctttgggaaggggaagtaggg

SEQ ID NO: 1314 - DNA, 25 bp, Artificial sequence
  Synthetic sequence: Probe suitable for detection of genetic variations associated with adverse reactions to pharmaceuticals
gcttctttgggagggggaagtaggg

SEQ ID NO: 1315 - DNA, 25 bp, Artificial sequence
  Synthetic sequence: Probe suitable for detection of genetic variations associated with adverse reactions to pharmaceuticals
ccctacttccccttcccaaagaagc

SEQ ID NO: 1316 - DNA, 25 bp, Artificial sequence
  Synthetic sequence: Probe suitable for detection of genetic variations associated with adverse reactions to pharmaceuticals
ccctacttccccctcccaaagaagc

SEQ ID NO: 1317 - DNA, 20 bp, Artificial Sequence
  Synthetic sequence: PCR primer suitable for amplifying target DNA regions comprising genetic variations associated with IBD
agttggggaggtcttgaagg

SEQ ID NO: 1318 - DNA, 20 bp, Artificial Sequence
  Synthetic sequence: PCR primer suitable for amplifying target DNA regions comprising genetic variations associated with IBD
cctatggcgcaacatctgta

SEQ ID NO: 1319 - DNA, 19 bp, Artificial Sequence
  Synthetic sequence: PCR primer suitable for amplifying target DNA regions comprising genetic variations associated with IBD
ggaagagctgcaggtggac

SEQ ID NO: 1320 - DNA, 20 bp, Artificial Sequence
  Synthetic sequence: PCR primer suitable for amplifying target DNA regions comprising genetic variations associated with IBD
gaatcgctttagcgaacacc

SEQ ID NO: 1321 - DNA, 22 bp, Artificial Sequence
  Synthetic sequence: PCR primer suitable for amplifying target DNA regions comprising genetic variations associated with IBD
tctgagctttggacttctgaca

SEQ ID NO: 1322 - DNA, 20 bp, Artificial Sequence
  Synthetic sequence: PCR primer suitable for amplifying target DNA regions comprising genetic variations associated with IBD
agggtggcaagaaatcttca

SEQ ID NO: 1323 - DNA, 20 bp, Artificial Sequence
  Synthetic sequence: PCR primer suitable for amplifying target DNA regions comprising genetic variations associated with IBD
tcccatttccgtctttttga

SEQ ID NO: 1324 - DNA, 19 bp, Artificial Sequence
  Synthetic sequence: PCR primer suitable for amplifying target DNA regions comprising genetic variations associated with IBD
caaaatccttcccgctgag

SEQ ID NO: 1325 - DNA, 24 bp, Artificial Sequence
  Synthetic sequence: PCR primer suitable for amplifying target DNA regions comprising genetic variations associated with IBD
actttagggtgcttacaactgact

SEQ ID NO: 1326 - DNA, 20 bp, Artificial Sequence
  Synthetic sequence: PCR primer suitable for amplifying target DNA regions comprising genetic variations associated with IBD
gactctgaccaggcatttcc

SEQ ID NO: 1327 - DNA, 20 bp, Artificial Sequence
  Synthetic sequence: PCR primer suitable for amplifying target DNA regions comprising genetic variations associated with IBD
gcctcaacctctcaaagtgc

SEQ ID NO: 1328 - DNA, 20 bp, Artificial Sequence
  Synthetic sequence: PCR primer suitable for amplifying target DNA regions comprising genetic variations associated with IBD
aattcacatcactgccacca

SEQ ID NO: 1329 - DNA, 20 bp, Artificial Sequence
  Synthetic sequence: PCR primer suitable for amplifying target DNA regions comprising genetic variations associated with IBD
cactatctctccccgacagc

SEQ ID NO: 1330 - DNA, 20 bp, Artificial Sequence
  Synthetic sequence: PCR primer suitable for amplifying target DNA regions comprising genetic variations associated with IBD
tggctgtgaagaacagcaaa

SEQ ID NO: 1331 - DNA, 20 bp, Artificial Sequence
  Synthetic sequence: PCR primer suitable for amplifying target DNA regions comprising genetic variations associated with IBD
gagaatgcccagaagatcca

SEQ ID NO: 1332 - DNA, 20 bp, Artificial Sequence
  Synthetic sequence: PCR primer suitable for amplifying target DNA regions comprising genetic variations associated with IBD
aagcagaatccctcctccag

SEQ ID NO: 1333 - DNA, 20 bp, Artificial Sequence
  Synthetic sequence: PCR primer suitable for amplifying target DNA regions comprising genetic variations associated with IBD
ggctgcgaagtctgtaaacc

SEQ ID NO: 1334 - DNA, 20 bp, Artificial Sequence
  Synthetic sequence: PCR primer suitable for amplifying target DNA regions comprising genetic variations associated with IBD
cgctacatgcttcaaactcg

SEQ ID NO: 1335 - DNA, 20 bp, Artificial Sequence
  Synthetic sequence: PCR primer suitable for amplifying target DNA regions comprising genetic variations associated with IBD
gcggcgattacagaaaacat

SEQ ID NO: 1336 - DNA, 20 bp, Artificial Sequence
  Synthetic sequence: PCR primer suitable for amplifying target DNA regions comprising genetic variations associated with IBD
aatgccatgctccattcttt

SEQ ID NO: 1337 - DNA, 20 bp, Artificial Sequence
  Synthetic sequence: PCR primer suitable for amplifying target DNA regions comprising genetic variations associated with IBD
gagaaaccccacaaccagtg

SEQ ID NO: 1338 - DNA, 20 bp, Artificial Sequence
  Synthetic sequence: PCR primer suitable for amplifying target DNA regions comprising genetic variations associated with IBD
agcggctacttttcccaaat

SEQ ID NO: 1339 - DNA, 20 bp, Artificial Sequence
  Synthetic sequence: PCR primer suitable for amplifying target DNA regions comprising genetic variations associated with IBD
cagagtctcacccccacatt

SEQ ID NO: 1340 - DNA, 20 bp, Artificial Sequence
  Synthetic sequence: PCR primer suitable for amplifying target DNA regions comprising genetic variations associated with IBD
ctcagatcagcagggagagg

SEQ ID NO: 1341 - DNA, 20 bp, Artificial Sequence
  Synthetic sequence: PCR primer suitable for amplifying target DNA regions comprising genetic variations associated with IBD
tccctccagtgagcaggtat

SEQ ID NO: 1342 - DNA, 20 bp, Artificial Sequence
  Synthetic sequence: PCR primer suitable for amplifying target DNA regions comprising genetic variations associated with IBD
gcatcacccaggatgaagat

SEQ ID NO: 1343 - DNA, 20 bp, Artificial Sequence
  Synthetic sequence: PCR primer suitable for amplifying target DNA regions comprising genetic variations associated with IBD
tcaggttcttccaggagtgg

SEQ ID NO: 1344 - DNA, 20 bp, Artificial Sequence
  Synthetic sequence: PCR primer suitable for amplifying target DNA regions comprising genetic variations associated with IBD
ctgtttggctttggacaaca

SEQ ID NO: 1345 - DNA, 19 bp, Artificial Sequence
  Synthetic sequence: PCR primer suitable for amplifying target DNA regions comprising genetic variations associated with IBD
cgcctcactgttctcaggt

SEQ ID NO: 1346 - DNA, 20 bp, Artificial Sequence
  Synthetic sequence: PCR primer suitable for amplifying target DNA regions comprising genetic variations associated with IBD
aagctttgcaccttgacctc

SEQ ID NO: 1347 - DNA, 20 bp, Artificial Sequence
  Synthetic sequence: PCR primer suitable for amplifying target DNA regions comprising genetic variations associated with IBD
tcacttgctgagaacccaga

SEQ ID NO: 1348 - DNA, 20 bp, Artificial Sequence
  Synthetic sequence: PCR primer suitable for amplifying target DNA regions comprising genetic variations associated with IBD
ggaccctgggactagaggag

SEQ ID NO: 1349 - DNA, 20 bp, Artificial Sequence
  Synthetic sequence: PCR primer suitable for amplifying target DNA regions comprising genetic variations associated with IBD
acttaattgcctgggtgacg

SEQ ID NO: 1350 - DNA, 20 bp, Artificial Sequence
  Synthetic sequence: PCR primer suitable for amplifying target DNA regions comprising genetic variations associated with IBD
gcaattcaccaaactgatcg

SEQ ID NO: 1351 - DNA, 20 bp, Artificial Sequence
  Synthetic sequence: PCR primer suitable for amplifying target DNA regions comprising genetic variations associated with IBD
ccacctttgcttttctcacc

SEQ ID NO: 1352 - DNA, 20 bp, Artificial Sequence
  Synthetic sequence: PCR primer suitable for amplifying target DNA regions comprising genetic variations associated with IBD
ctgcgtttgtgcttgtgttt

SEQ ID NO: 1353 - DNA, 20 bp, Artificial Sequence
  Synthetic sequence: PCR primer suitable for amplifying target DNA regions comprising genetic variations associated with IBD
tttggggagctgaaggacta

SEQ ID NO: 1354 - DNA, 20 bp, Artificial Sequence
  Synthetic sequence: PCR primer suitable for amplifying target DNA regions comprising genetic variations associated with IBD
ctttgtgaccattccggttt

SEQ ID NO: 1355 - DNA, 20 bp, Artificial Sequence
  Synthetic sequence: PCR primer suitable for amplifying target DNA regions comprising genetic variations associated with IBD
tggtgtctccaggtcaatca

SEQ ID NO: 1356 - DNA, 20 bp, Artificial Sequence
  Synthetic sequence: PCR primer suitable for amplifying target DNA regions comprising genetic variations associated with IBD
ggctgatccttcccagaaat

SEQ ID NO: 1357 - DNA, 20 bp, Artificial Sequence
  Synthetic sequence: PCR primer suitable for amplifying target DNA regions comprising genetic variations associated with IBD
actgtttggtgggcttcatc

SEQ ID NO: 1358 - DNA, 20 bp, Artificial Sequence
  Synthetic sequence: PCR primer suitable for amplifying target DNA regions comprising genetic variations associated with IBD
agggatccatcaccaggttt

SEQ ID NO: 1359 - DNA, 20 bp, Artificial Sequence
  Synthetic sequence: PCR primer suitable for amplifying target DNA regions comprising genetic variations associated with IBD
agggttatgtggcaatgacg

SEQ ID NO: 1360 - DNA, 20 bp, Artificial Sequence
  Synthetic sequence: PCR primer suitable for amplifying target DNA regions comprising genetic variations associated with IBD
accaatgctcatcccaactc

SEQ ID NO: 1361 - DNA, 20 bp, Artificial Sequence
  Synthetic sequence: PCR primer suitable for amplifying target DNA regions comprising genetic variations associated with IBD
catgaaccaccatgctcagt

SEQ ID NO: 1362 - DNA, 20 bp, Artificial Sequence
  Synthetic sequence: PCR primer suitable for amplifying target DNA regions comprising genetic variations associated with IBD
accacactcagggtctctgg

SEQ ID NO: 1363 - DNA, 20 bp, Artificial Sequence
  Synthetic sequence: PCR primer suitable for amplifying target DNA regions comprising genetic variations associated with IBD
agaatggctactgggtggtg

SEQ ID NO: 1364 - DNA, 20 bp, Artificial Sequence
  Synthetic sequence: PCR primer suitable for amplifying target DNA regions comprising genetic variations associated with IBD
agagcagctggcgaatgtat

SEQ ID NO: 1365 - DNA, 20 bp, Artificial Sequence
  Synthetic sequence: PCR primer suitable for amplifying target DNA regions comprising genetic variations associated with IBD
tcaaagtctccagggtcagg

SEQ ID NO: 1366 - DNA, 20 bp, Artificial Sequence
  Synthetic sequence: PCR primer suitable for amplifying target DNA regions comprising genetic variations associated with IBD
agggcgaatcatgtatgagg

SEQ ID NO: 1367 - DNA, 20 bp, Artificial Sequence
  Synthetic sequence: PCR primer suitable for amplifying target DNA regions comprising genetic variations associated with IBD
catccccatttgctcacttt

SEQ ID NO: 1368 - DNA, 20 bp, Artificial Sequence
  Synthetic sequence: PCR primer suitable for amplifying target DNA regions comprising genetic variations associated with IBD
gcctggtcactctcagttcc

SEQ ID NO: 1369 - DNA, 20 bp, Artificial Sequence
  Synthetic sequence: PCR primer suitable for amplifying target DNA regions comprising genetic variations associated with IBD
cgaggagttcccaacaggta

SEQ ID NO: 1370 - DNA, 20 bp, Artificial Sequence
  Synthetic sequence: PCR primer suitable for amplifying target DNA regions comprising genetic variations associated with IBD
ggcttttgtctcctttgtgg

SEQ ID NO: 1371 - DNA, 20 bp, Artificial Sequence
  Synthetic sequence: PCR primer suitable for amplifying target DNA regions comprising genetic variations associated with IBD
tccagtgtttgtccatgctg

SEQ ID NO: 1372 - DNA, 23 bp, Artificial Sequence
  Synthetic sequence: PCR primer suitable for amplifying target DNA regions comprising genetic variations associated with IBD
ttcccctgatgttaaaagaaaca

SEQ ID NO: 1373 - DNA, 20 bp, Artificial Sequence
  Synthetic sequence: PCR primer suitable for amplifying target DNA regions comprising genetic variations associated with IBD
gtcaacagttcccctttgga

SEQ ID NO: 1374 - DNA, 20 bp, Artificial Sequence
  Synthetic sequence: PCR primer suitable for amplifying target DNA regions comprising genetic variations associated with IBD
tggcaggggataagtaccag

SEQ ID NO: 1375 - DNA, 20 bp, Artificial Sequence
  Synthetic sequence: PCR primer suitable for amplifying target DNA regions comprising genetic variations associated with IBD
actgtttggtgggcttcatc

SEQ ID NO: 1376 - DNA, 23 bp, Artificial Sequence
  Synthetic sequence: PCR primer suitable for amplifying target DNA regions comprising genetic variations associated with IBD
gggtgatacatacacaagggttt

SEQ ID NO: 1377 - DNA, 20 bp, Artificial Sequence
  Synthetic sequence: PCR primer suitable for amplifying target DNA regions comprising genetic variations associated with IBD
cctgccaaagaagaaacacc

SEQ ID NO: 1378 - DNA, 20 bp, Artificial Sequence
  Synthetic sequence: PCR primer suitable for amplifying target DNA regions comprising genetic variations associated with IBD
gatgaagcccaccaaacagt

SEQ ID NO: 1379 - DNA, 20 bp, Artificial Sequence
  Synthetic sequence: PCR primer suitable for amplifying target DNA regions comprising genetic variations associated with IBD
ggggatcatggacattgaag

SEQ ID NO: 1380 - DNA, 20 bp, Artificial Sequence
  Synthetic sequence: PCR primer suitable for amplifying target DNA regions comprising genetic variations associated with IBD
tgtggtcagagcccagtaca

SEQ ID NO: 1381 - DNA, 20 bp, Artificial Sequence
  Synthetic sequence: PCR primer suitable for amplifying target DNA regions comprising genetic variations associated with IBD
ccttctgggggaactttaca

SEQ ID NO: 1382 - DNA, 21 bp, Artificial Sequence
  Synthetic sequence: PCR primer suitable for amplifying target DNA regions comprising genetic variations associated with IBD
cgctgtaaggttgatctttgg

SEQ ID NO: 1383 - DNA, 20 bp, Artificial Sequence
  Synthetic sequence: PCR primer suitable for amplifying target DNA regions comprising genetic variations associated with IBD
ctgaacaccgctcccataaa

SEQ ID NO: 1384 - DNA, 20 bp, Artificial Sequence
  Synthetic sequence: PCR primer suitable for amplifying target DNA regions comprising genetic variations associated with IBD
cctcctccatcttcatgctc

SEQ ID NO: 1385 - DNA, 20 bp, Artificial Sequence
  Synthetic sequence: PCR primer suitable for amplifying target DNA regions comprising genetic variations associated with IBD
ccgggatcaggaaagaagat

SEQ ID NO: 1386 - DNA, 20 bp, Artificial Sequence
  Synthetic sequence: PCR primer suitable for amplifying target DNA regions comprising genetic variations associated with IBD
aggggctttcagttttccat

SEQ ID NO: 1387 - DNA, 21 bp, Artificial Sequence
  Synthetic sequence: PCR primer suitable for amplifying target DNA regions comprising genetic variations associated with IBD
tgtgtgggtattgttgcattg

SEQ ID NO: 1388 - DNA, 20 bp, Artificial Sequence
  Synthetic sequence: PCR primer suitable for amplifying target DNA regions comprising genetic variations associated with IBD
ccatgtaccacagcttgctc

SEQ ID NO: 1389 - DNA, 20 bp, Artificial Sequence
  Synthetic sequence: PCR primer suitable for amplifying target DNA regions comprising genetic variations associated with IBD
ctcattggtggggaagaaga

SEQ ID NO: 1390 - DNA, 20 bp, Artificial Sequence
  Synthetic sequence: PCR primer suitable for amplifying target DNA regions comprising genetic variations associated with IBD
cgaactgcctcctgacattt

SEQ ID NO: 1391 - DNA, 18 bp, Artificial Sequence
  Synthetic sequence: PCR primer suitable for amplifying target DNA regions comprising genetic variations associated with IBD
gcccaggagcctgaagac

SEQ ID NO: 1392 - DNA, 20 bp, Artificial Sequence
  Synthetic sequence: PCR primer suitable for amplifying target DNA regions comprising genetic variations associated with IBD
ccttctctctgcgtttgctc

SEQ ID NO: 1393 - DNA, 20 bp, Artificial Sequence
  Synthetic sequence: PCR primer suitable for amplifying target DNA regions comprising genetic variations associated with IBD
ggcctcaatgaactcctcaa

SEQ ID NO: 1394 - DNA, 20 bp, Artificial Sequence
  Synthetic sequence: PCR primer suitable for amplifying target DNA regions comprising genetic variations associated with IBD
ggatagcaactgctccaagg

SEQ ID NO: 1395 - DNA, 20 bp, Artificial Sequence
  Synthetic sequence: PCR primer suitable for amplifying target DNA regions comprising genetic variations associated with IBD
acttcaccaacatgcaggac

SEQ ID NO: 1396 - DNA, 20 bp, Artificial Sequence
  Synthetic sequence: PCR primer suitable for amplifying target DNA regions comprising genetic variations associated with IBD
caggtcacagctctcaatgc

SEQ ID NO: 1397 - DNA, 20 bp, Artificial Sequence
  Synthetic sequence: PCR primer suitable for amplifying target DNA regions comprising genetic variations associated with IBD
tggttaaggatgcccagaag

SEQ ID NO: 1398 - DNA, 21 bp, Artificial Sequence
  Synthetic sequence: PCR primer suitable for amplifying target DNA regions comprising genetic variations associated with IBD
cgaaaagacaacctcaagcac

SEQ ID NO: 1399 - DNA, 20 bp, Artificial Sequence
  Synthetic sequence: PCR primer suitable for amplifying target DNA regions comprising genetic variations associated with IBD
ctgtcgtccatgctgtgttt

SEQ ID NO: 1400 - DNA, 20 bp, Artificial Sequence
  Synthetic sequence: PCR primer suitable for amplifying target DNA regions comprising genetic variations associated with IBD
gaccagccccaagatgacta

SEQ ID NO: 1401 - DNA, 20 bp, Artificial Sequence
  Synthetic sequence: PCR primer suitable for amplifying target DNA regions comprising genetic variations associated with IBD
gcctcaatgacgacctaagc

SEQ ID NO: 1402 - DNA, 20 bp, Artificial Sequence
  Synthetic sequence: PCR primer suitable for amplifying target DNA regions comprising genetic variations associated with IBD
tcatgggaaaatcccacatt

SEQ ID NO: 1403 - DNA, 20 bp, Artificial Sequence
  Synthetic sequence: PCR primer suitable for amplifying target DNA regions comprising genetic variations associated with IBD
aagaaaaccccagcagtgtg

SEQ ID NO: 1404 - DNA, 20 bp, Artificial Sequence
  Synthetic sequence: PCR primer suitable for amplifying target DNA regions comprising genetic variations associated with IBD
gccttttggaaaatcaacca

SEQ ID NO: 1405 - DNA, 20 bp, Artificial Sequence
  Synthetic sequence: PCR primer suitable for amplifying target DNA regions comprising genetic variations associated with IBD
gaagacccaggtccagatga

SEQ ID NO: 1406 - DNA, 20 bp, Artificial Sequence
  Synthetic sequence: PCR primer suitable for amplifying target DNA regions comprising genetic variations associated with IBD
actgaccgtgcaagtcacag

SEQ ID NO: 1407 - DNA, 20 bp, Artificial Sequence
  Synthetic sequence: PCR primer suitable for amplifying target DNA regions comprising genetic variations associated with IBD
ctgtcatcgacccactgatg

SEQ ID NO: 1408 - DNA, 19 bp, Artificial Sequence
  Synthetic sequence: PCR primer suitable for amplifying target DNA regions comprising genetic variations associated with IBD
gacacagggaaggctcaca

SEQ ID NO: 1409 - DNA, 20 bp, Artificial Sequence
  Synthetic sequence: PCR primer suitable for amplifying target DNA regions comprising genetic variations associated with IBD
aagaaaaccccagcagtgtg

SEQ ID NO: 1410 - DNA, 20 bp, Artificial Sequence
  Synthetic sequence: PCR primer suitable for amplifying target DNA regions comprising genetic variations associated with IBD
gccttttggaaaatcaacca

SEQ ID NO: 1411 - DNA, 20 bp, Artificial Sequence
  Synthetic sequence: PCR primer suitable for amplifying target DNA regions comprising genetic variations associated with IBD
aagaaaaccccagcagtgtg

SEQ ID NO: 1412 - DNA, 20 bp, Artificial Sequence
  Synthetic sequence: PCR primer suitable for amplifying target DNA regions comprising genetic variations associated with IBD
gccttttggaaaatcaacca

SEQ ID NO: 1413 - DNA, 20 bp, Artificial Sequence
  Synthetic sequence: PCR primer suitable for amplifying target DNA regions comprising genetic variations associated with IBD
gtagatgaagtcccccagca

SEQ ID NO: 1414 - DNA, 20 bp, Artificial Sequence
  Synthetic sequence: PCR primer suitable for amplifying target DNA regions comprising genetic variations associated with IBD
gcattgaacccgtcttgttt

SEQ ID NO: 1415 - DNA, 21 bp, Artificial Sequence
  Synthetic sequence: PCR primer suitable for amplifying target DNA regions comprising genetic variations associated with IBD
gcaccgacatttactgacacc

SEQ ID NO: 1416 - DNA, 20 bp, Artificial Sequence
  Synthetic sequence: PCR primer suitable for amplifying target DNA regions comprising genetic variations associated with IBD
atgaggctggagaagaagca

SEQ ID NO: 1417 - DNA, 19 bp, Artificial Sequence
  Synthetic sequence: PCR primer suitable for amplifying target DNA regions comprising genetic variations associated with IBD
gagcacgtggtggagtttg

SEQ ID NO: 1418 - DNA, 20 bp, Artificial Sequence
  Synthetic sequence: PCR primer suitable for amplifying target DNA regions comprising genetic variations associated with IBD
ttgtccaagtccctccacac

SEQ ID NO: 1419 - DNA, 20 bp, Artificial Sequence
  Synthetic sequence: PCR primer suitable for amplifying target DNA regions comprising genetic variations associated with IBD
atggccacgtcgttgttatt

SEQ ID NO: 1420 - DNA, 20 bp, Artificial Sequence
  Synthetic sequence: PCR primer suitable for amplifying target DNA regions comprising genetic variations associated with IBD
agccacctgtgcttcttcac

SEQ ID NO: 1421 - DNA, 20 bp, Artificial Sequence
  Synthetic sequence: PCR primer suitable for amplifying target DNA regions comprising genetic variations associated with IBD
gtgttcagaggatgggcatt

SEQ ID NO: 1422 - DNA, 20 bp, Artificial Sequence
  Synthetic sequence: PCR primer suitable for amplifying target DNA regions comprising genetic variations associated with IBD
ggggctgaataaagggttgt

SEQ ID NO: 1423 - DNA, 20 bp, Artificial Sequence
  Synthetic sequence: PCR primer suitable for amplifying target DNA regions comprising genetic variations associated with IBD
gagctacgcacatcaccaaa

SEQ ID NO: 1424 - DNA, 20 bp, Artificial Sequence
  Synthetic sequence: PCR primer suitable for amplifying target DNA regions comprising genetic variations associated with IBD
ggtcctctttgcaatccaga

SEQ ID NO: 1425 - DNA, 20 bp, Artificial Sequence
  Synthetic sequence: PCR primer suitable for amplifying target DNA regions comprising genetic variations associated with IBD
cagacgacacaggaagcaga

SEQ ID NO: 1426 - DNA, 20 bp, Artificial Sequence
  Synthetic sequence: PCR primer suitable for amplifying target DNA regions comprising genetic variations associated with IBD
tgtctgagcaccacttttgg

SEQ ID NO: 1427 - DNA, 20 bp, Artificial Sequence
  Synthetic sequence: PCR primer suitable for amplifying target DNA regions comprising genetic variations associated with IBD
gggaaagagtgagtgggaca

SEQ ID NO: 1428 - DNA, 20 bp, Artificial Sequence
  Synthetic sequence: PCR primer suitable for amplifying target DNA regions comprising genetic variations associated with IBD
cccctgggtctgtgttttta

SEQ ID NO: 1429 - DNA, 23 bp, Artificial sequence
  Synthetic sequence: Probe suitable for detection of genetic variations associated with IBD
tcacagacgttcctggaatggac

SEQ ID NO: 1430 - DNA, 23 bp, Artificial sequence
  Synthetic sequence: Probe suitable for detection of genetic variations associated with IBD
tcacagacgtttctggaatggac

SEQ ID NO: 1431 - DNA, 23 bp, Artificial sequence
  Synthetic sequence: Probe suitable for detection of genetic variations associated with IBD
gtccattccaggaacgtctgtga

SEQ ID NO: 1432 - DNA, 23 bp, Artificial sequence
  Synthetic sequence: Probe suitable for detection of genetic variations associated with IBD
gtccattccagaaacgtctgtga

SEQ ID NO: 1433 - DNA, 23 bp, Artificial sequence
  Synthetic sequence: Probe suitable for detection of genetic variations associated with IBD
gtcctgctgagccgcgagctgtt

SEQ ID NO: 1434 - DNA, 23 bp, Artificial sequence
  Synthetic sequence: Probe suitable for detection of genetic variations associated with IBD
gtcctgctgagtcgcgagctgtt

SEQ ID NO: 1435 - DNA, 23 bp, Artificial sequence
  Synthetic sequence: Probe suitable for detection of genetic variations associated with IBD
aacagctcgcggctcagcaggac

SEQ ID NO: 1436 - DNA, 23 bp, Artificial sequence
  Synthetic sequence: Probe suitable for detection of genetic variations associated with IBD
aacagctcgcgactcagcaggac

SEQ ID NO: 1437 - DNA, 23 bp, Artificial sequence
  Synthetic sequence: Probe suitable for detection of genetic variations associated with IBD
ttctcataatagaatccagtatc

SEQ ID NO: 1438 - DNA, 23 bp, Artificial sequence
  Synthetic sequence: Probe suitable for detection of genetic variations associated with IBD
ttctcataatacaatccagtatc

SEQ ID NO: 1439 - DNA, 23 bp, Artificial sequence
  Synthetic sequence: Probe suitable for detection of genetic variations associated with IBD
gatactggattctattatgagaa

SEQ ID NO: 1440 - DNA, 23 bp, Artificial sequence
  Synthetic sequence: Probe suitable for detection of genetic variations associated with IBD
gatactggattgtattatgagaa

SEQ ID NO: 1441 - DNA, 23 bp, Artificial sequence
  Synthetic sequence: Probe suitable for detection of genetic variations associated with IBD
ctgcaagctgcggaagataatga

SEQ ID NO: 1442 - DNA, 23 bp, Artificial sequence
  Synthetic sequence: Probe suitable for detection of genetic variations associated with IBD
ctgcaagctgcagaagataatga

SEQ ID NO: 1443 - DNA, 23 bp, Artificial sequence
  Synthetic sequence: Probe suitable for detection of genetic variations associated with IBD
tcattatcttccgcagcttgcag

SEQ ID NO: 1444 - DNA, 23 bp, Artificial sequence
  Synthetic sequence: Probe suitable for detection of genetic variations associated with IBD
tcattatcttctgcagcttgcag

SEQ ID NO: 1445 - DNA, 23 bp, Artificial sequence
  Synthetic sequence: Probe suitable for detection of genetic variations associated with IBD
tcaccagaggtccaaccttactg

SEQ ID NO: 1446 - DNA, 23 bp, Artificial sequence
  Synthetic sequence: Probe suitable for detection of genetic variations associated with IBD
tcaccagaggttcaaccttactg

SEQ ID NO: 1447 - DNA, 23 bp, Artificial sequence
  Synthetic sequence: Probe suitable for detection of genetic variations associated with IBD
cagtaaggttggacctctggtga

SEQ ID NO: 1448 - DNA, 23 bp, Artificial sequence
  Synthetic sequence: Probe suitable for detection of genetic variations associated with IBD
cagtaaggttgaacctctggtga

SEQ ID NO: 1449 - DNA, 23 bp, Artificial sequence
  Synthetic sequence: Probe suitable for detection of genetic variations associated with IBD
gatggggggaaaaaccatgtctt

SEQ ID NO: 1450 - DNA, 23 bp, Artificial sequence
  Synthetic sequence: Probe suitable for detection of genetic variations associated with IBD
gatggggggaaaaaaccatgtct

SEQ ID NO: 1451 - DNA, 23 bp, Artificial sequence
  Synthetic sequence: Probe suitable for detection of genetic variations associated with IBD
aagacatggtttttccccccatc

SEQ ID NO: 1452 - DNA, 23 bp, Artificial sequence
  Synthetic sequence: Probe suitable for detection of genetic variations associated with IBD
agacatggttttttccccccatc

SEQ ID NO: 1453 - DNA, 23 bp, Artificial sequence
  Synthetic sequence: Probe suitable for detection of genetic variations associated with IBD
gcccgcccccccccacacacagc

SEQ ID NO: 1454 - DNA, 23 bp, Artificial sequence
  Synthetic sequence: Probe suitable for detection of genetic variations associated with IBD
gcccgccccccacacacacagca

SEQ ID NO: 1455 - DNA, 23 bp, Artificial sequence
  Synthetic sequence: Probe suitable for detection of genetic variations associated with IBD
gctgtgtgtgggggggggcgggc

SEQ ID NO: 1456 - DNA, 23 bp, Artificial sequence
  Synthetic sequence: Probe suitable for detection of genetic variations associated with IBD
tgctgtgtgtgtggggggcgggc

SEQ ID NO: 1457 - DNA, 23 bp, Artificial sequence
  Synthetic sequence: Probe suitable for detection of genetic variations associated with IBD
tggggtggggcaggggtcgccga

SEQ ID NO: 1458 - DNA, 23 bp, Artificial sequence
  Synthetic sequence: Probe suitable for detection of genetic variations associated with IBD
tggggtggggcggggtcgccgag

SEQ ID NO: 1459 - DNA, 23 bp, Artificial sequence
  Synthetic sequence: Probe suitable for detection of genetic variations associated with IBD
tcggcgacccctgccccacccca

SEQ ID NO: 1460 - DNA, 23 bp, Artificial sequence
  Synthetic sequence: Probe suitable for detection of genetic variations associated with IBD
ctcggcgaccccgccccacccca

SEQ ID NO: 1461 - DNA, 23 bp, Artificial sequence
  Synthetic sequence: Probe suitable for detection of genetic variations associated with IBD
ggaggcgggatctgcgtgcgggc

SEQ ID NO: 1462 - DNA, 23 bp, Artificial sequence
  Synthetic sequence: Probe suitable for detection of genetic variations associated with IBD
ggaggcgggatttgcgtgcgggc

SEQ ID NO: 1463 - DNA, 23 bp, Artificial sequence
  Synthetic sequence: Probe suitable for detection of genetic variations associated with IBD
gcccgcacgcagatcccgcctcc

SEQ ID NO: 1464 - DNA, 23 bp, Artificial sequence
  Synthetic sequence: Probe suitable for detection of genetic variations associated with IBD
gcccgcacgcaaatcccgcctcc

SEQ ID NO: 1465 - DNA, 23 bp, Artificial sequence
  Synthetic sequence: Probe suitable for detection of genetic variations associated with IBD
gaaggaagctgcgcaacacccct

SEQ ID NO: 1466 - DNA, 23 bp, Artificial sequence
  Synthetic sequence: Probe suitable for detection of genetic variations associated with IBD
gaaggaagctgtgcaacacccct

SEQ ID NO: 1467 - DNA, 23 bp, Artificial sequence
  Synthetic sequence: Probe suitable for detection of genetic variations associated with IBD
aggggtgttgcgcagcttccttc

SEQ ID NO: 1468 - DNA, 23 bp, Artificial sequence
  Synthetic sequence: Probe suitable for detection of genetic variations associated with IBD
aggggtgttgcacagcttccttc

SEQ ID NO: 1469 - DNA, 23 bp, Artificial sequence
  Synthetic sequence: Probe suitable for detection of genetic variations associated with IBD
gaggtggggtgagctctttctgt

SEQ ID NO: 1470 - DNA, 23 bp, Artificial sequence
  Synthetic sequence: Probe suitable for detection of genetic variations associated with IBD
gaggtggggtgggctctttctgt

SEQ ID NO: 1471 - DNA, 23 bp, Artificial sequence
  Synthetic sequence: Probe suitable for detection of genetic variations associated with IBD
acagaaagagctcaccccacctc

SEQ ID NO: 1472 - DNA, 23 bp, Artificial sequence
  Synthetic sequence: Probe suitable for detection of genetic variations associated with IBD
acagaaagagcccaccccacctc

SEQ ID NO: 1473 - DNA, 23 bp, Artificial sequence
  Synthetic sequence: Probe suitable for detection of genetic variations associated with IBD
tacttctcggcggaagatgcgga

SEQ ID NO: 1474 - DNA, 23 bp, Artificial sequence
  Synthetic sequence: Probe suitable for detection of genetic variations associated with IBD
tacttctcggccgaagatgcgga

SEQ ID NO: 1475 - DNA, 23 bp, Artificial sequence
  Synthetic sequence: Probe suitable for detection of genetic variations associated with IBD
tccgcatcttccgccgagaagta

SEQ ID NO: 1476 - DNA, 23 bp, Artificial sequence
  Synthetic sequence: Probe suitable for detection of genetic variations associated with IBD
tccgcatcttcggccgagaagta

SEQ ID NO: 1477 - DNA, 23 bp, Artificial sequence
  Synthetic sequence: Probe suitable for detection of genetic variations associated with IBD
atctacatggacaccatcatgga

SEQ ID NO: 1478 - DNA, 23 bp, Artificial sequence
  Synthetic sequence: Probe suitable for detection of genetic variations associated with IBD
atctacatggataccatcatgga

SEQ ID NO: 1479 - DNA, 23 bp, Artificial sequence
  Synthetic sequence: Probe suitable for detection of genetic variations associated with IBD
tccatgatggtgtccatgtagat

SEQ ID NO: 1480 - DNA, 23 bp, Artificial sequence
  Synthetic sequence: Probe suitable for detection of genetic variations associated with IBD
tccatgatggtatccatgtagat

SEQ ID NO: 1481 - DNA, 23 bp, Artificial sequence
  Synthetic sequence: Probe suitable for detection of genetic variations associated with IBD
agtggtccggcacgggaagacct

SEQ ID NO: 1482 - DNA, 23 bp, Artificial sequence
  Synthetic sequence: Probe suitable for detection of genetic variations associated with IBD
agtggtccggcgcgggaagacct

SEQ ID NO: 1483 - DNA, 23 bp, Artificial sequence
  Synthetic sequence: Probe suitable for detection of genetic variations associated with IBD
aggtcttcccgtgccggaccact

SEQ ID NO: 1484 - DNA, 23 bp, Artificial sequence
  Synthetic sequence: Probe suitable for detection of genetic variations associated with IBD
aggtcttcccgcgccggaccact

SEQ ID NO: 1485 - DNA, 23 bp, Artificial sequence
  Synthetic sequence: Probe suitable for detection of genetic variations associated with IBD
cgggaatggcaccatggaccagg

SEQ ID NO: 1486 - DNA, 23 bp, Artificial sequence
  Synthetic sequence: Probe suitable for detection of genetic variations associated with IBD
cgggaatggcatcatggaccagg

SEQ ID NO: 1487 - DNA, 23 bp, Artificial sequence
  Synthetic sequence: Probe suitable for detection of genetic variations associated with IBD
cctggtccatggtgccattcccg

SEQ ID NO: 1488 - DNA, 23 bp, Artificial sequence
  Synthetic sequence: Probe suitable for detection of genetic variations associated with IBD
cctggtccatgatgccattcccg

SEQ ID NO: 1489 - DNA, 23 bp, Artificial sequence
  Synthetic sequence: Probe suitable for detection of genetic variations associated with IBD
atttcttagcccagctacctgta

SEQ ID NO: 1490 - DNA, 23 bp, Artificial sequence
  Synthetic sequence: Probe suitable for detection of genetic variations associated with IBD
atttcttagcctagctacctgta

SEQ ID NO: 1491 - DNA, 23 bp, Artificial sequence
  Synthetic sequence: Probe suitable for detection of genetic variations associated with IBD
tacaggtagctgggctaagaaat

SEQ ID NO: 1492 - DNA, 23 bp, Artificial sequence
  Synthetic sequence: Probe suitable for detection of genetic variations associated with IBD
tacaggtagctaggctaagaaat

SEQ ID NO: 1493 - DNA, 23 bp, Artificial sequence
  Synthetic sequence: Probe suitable for detection of genetic variations associated with IBD
agaacttgtttagaacttgtcat

SEQ ID NO: 1494 - DNA, 23 bp, Artificial sequence
  Synthetic sequence: Probe suitable for detection of genetic variations associated with IBD
agaacttgtttggaacttgtcat

SEQ ID NO: 1495 - DNA, 23 bp, Artificial sequence
  Synthetic sequence: Probe suitable for detection of genetic variations associated with IBD
atgacaagttctaaacaagttct

SEQ ID NO: 1496 - DNA, 23 bp, Artificial sequence
  Synthetic sequence: Probe suitable for detection of genetic variations associated with IBD
atgacaagttccaaacaagttct

SEQ ID NO: 1497 - DNA, 23 bp, Artificial sequence
  Synthetic sequence: Probe suitable for detection of genetic variations associated with IBD
cagcagggtctcgatggccctgc

SEQ ID NO: 1498 - DNA, 23 bp, Artificial sequence
  Synthetic sequence: Probe suitable for detection of genetic variations associated with IBD
cagcagggtcttgatggccctgc

SEQ ID NO: 1499 - DNA, 23 bp, Artificial sequence
  Synthetic sequence: Probe suitable for detection of genetic variations associated with IBD
gcagggccatcgagaccctgctg

SEQ ID NO: 1500 - DNA, 23 bp, Artificial sequence
  Synthetic sequence: Probe suitable for detection of genetic variations associated with IBD
gcagggccatcaagaccctgctg

SEQ ID NO: 1501 - DNA, 23 bp, Artificial sequence
  Synthetic sequence: Probe suitable for detection of genetic variations associated with IBD
gaccagtgaagaaagtgtctttg

SEQ ID NO: 1502 - DNA, 23 bp, Artificial sequence
  Synthetic sequence: Probe suitable for detection of genetic variations associated with IBD
gaccagtgaagcaagtgtctttg

SEQ ID NO: 1503 - DNA, 23 bp, Artificial sequence
  Synthetic sequence: Probe suitable for detection of genetic variations associated with IBD
caaagacactttcttcactggtc

SEQ ID NO: 1504 - DNA, 23 bp, Artificial sequence
  Synthetic sequence: Probe suitable for detection of genetic variations associated with IBD
caaagacacttgcttcactggtc

SEQ ID NO: 1505 - DNA, 23 bp, Artificial sequence
  Synthetic sequence: Probe suitable for detection of genetic variations associated with IBD
gcaggtgaccactgacggcagga

SEQ ID NO: 1506 - DNA, 23 bp, Artificial sequence
  Synthetic sequence: Probe suitable for detection of genetic variations associated with IBD
gcaggtgaccattgacggcagga

SEQ ID NO: 1507 - DNA, 23 bp, Artificial sequence
  Synthetic sequence: Probe suitable for detection of genetic variations associated with IBD
tcctgccgtcagtggtcacctgc

SEQ ID NO: 1508 - DNA, 23 bp, Artificial sequence
  Synthetic sequence: Probe suitable for detection of genetic variations associated with IBD
tcctgccgtcaatggtcacctgc

SEQ ID NO: 1509 - DNA, 23 bp, Artificial sequence
  Synthetic sequence: Probe suitable for detection of genetic variations associated with IBD
agaagtgctgaaaaatatattta

SEQ ID NO: 1510 - DNA, 23 bp, Artificial sequence
  Synthetic sequence: Probe suitable for detection of genetic variations associated with IBD
agaagtgctgagaaatatattta

SEQ ID NO: 1511 - DNA, 23 bp, Artificial sequence
  Synthetic sequence: Probe suitable for detection of genetic variations associated with IBD
taaatatatttttcagcacttct

SEQ ID NO: 1512 - DNA, 23 bp, Artificial sequence
  Synthetic sequence: Probe suitable for detection of genetic variations associated with IBD
taaatatatttctcagcacttct

SEQ ID NO: 1513 - DNA, 23 bp, Artificial sequence
  Synthetic sequence: Probe suitable for detection of genetic variations associated with IBD
gagtgtggtctagagttgggatg

SEQ ID NO: 1514 - DNA, 23 bp, Artificial sequence
  Synthetic sequence: Probe suitable for detection of genetic variations associated with IBD
gagtgtggtctggagttgggatg

SEQ ID NO: 1515 - DNA, 23 bp, Artificial sequence
  Synthetic sequence: Probe suitable for detection of genetic variations associated with IBD
catcccaactctagaccacactc

SEQ ID NO: 1516 - DNA, 23 bp, Artificial sequence
  Synthetic sequence: Probe suitable for detection of genetic variations associated with IBD
catcccaactccagaccacactc

SEQ ID NO: 1517 - DNA, 23 bp, Artificial sequence
  Synthetic sequence: Probe suitable for detection of genetic variations associated with IBD
aatgtcccagccgttttatgctt

SEQ ID NO: 1518 - DNA, 23 bp, Artificial sequence
  Synthetic sequence: Probe suitable for detection of genetic variations associated with IBD
aatgtcccagctgttttatgctt

SEQ ID NO: 1519 - DNA, 23 bp, Artificial sequence
  Synthetic sequence: Probe suitable for detection of genetic variations associated with IBD
aagcataaaacggctgggacatt

SEQ ID NO: 1520 - DNA, 23 bp, Artificial sequence
  Synthetic sequence: Probe suitable for detection of genetic variations associated with IBD
aagcataaaacagctgggacatt

SEQ ID NO: 1521 - DNA, 23 bp, Artificial sequence
  Synthetic sequence: Probe suitable for detection of genetic variations associated with IBD
ggactacagagctggaagcatct

SEQ ID NO: 1522 - DNA, 23 bp, Artificial sequence
  Synthetic sequence: Probe suitable for detection of genetic variations associated with IBD
ggactacagagttggaagcatct

SEQ ID NO: 1523 - DNA, 23 bp, Artificial sequence
  Synthetic sequence: Probe suitable for detection of genetic variations associated with IBD
agatgcttccagctctgtagtcc

SEQ ID NO: 1524 - DNA, 23 bp, Artificial sequence
  Synthetic sequence: Probe suitable for detection of genetic variations associated with IBD
agatgcttccaactctgtagtcc

SEQ ID NO: 1525 - DNA, 23 bp, Artificial sequence
  Synthetic sequence: Probe suitable for detection of genetic variations associated with IBD
ccattgcctccatccctgtaaga

SEQ ID NO: 1526 - DNA, 23 bp, Artificial sequence
  Synthetic sequence: Probe suitable for detection of genetic variations associated with IBD
ccattgcctccgtccctgtaaga

SEQ ID NO: 1527 - DNA, 23 bp, Artificial sequence
  Synthetic sequence: Probe suitable for detection of genetic variations associated with IBD
tcttacagggatggaggcaatgg

SEQ ID NO: 1528 - DNA, 23 bp, Artificial sequence
  Synthetic sequence: Probe suitable for detection of genetic variations associated with IBD
tcttacagggacggaggcaatgg

SEQ ID NO: 1529 - DNA, 23 bp, Artificial sequence
  Synthetic sequence: Probe suitable for detection of genetic variations associated with IBD
tttcctgccctcggttgtctttg

SEQ ID NO: 1530 - DNA, 23 bp, Artificial sequence
  Synthetic sequence: Probe suitable for detection of genetic variations associated with IBD
tttcctgccctgggttgtctttg

SEQ ID NO: 1531 - DNA, 23 bp, Artificial sequence
  Synthetic sequence: Probe suitable for detection of genetic variations associated with IBD
caaagacaaccgagggcaggaaa

SEQ ID NO: 1532 - DNA, 23 bp, Artificial sequence
  Synthetic sequence: Probe suitable for detection of genetic variations associated with IBD
caaagacaacccagggcaggaaa

SEQ ID NO: 1533 - DNA, 23 bp, Artificial sequence
  Synthetic sequence: Probe suitable for detection of genetic variations associated with IBD
ctggtggtcttggaagaagcgct

SEQ ID NO: 1534 - DNA, 23 bp, Artificial sequence
  Synthetic sequence: Probe suitable for detection of genetic variations associated with IBD
ctggtggtctttgaagaagcgct

SEQ ID NO: 1535 - DNA, 23 bp, Artificial sequence
  Synthetic sequence: Probe suitable for detection of genetic variations associated with IBD
agcgcttcttccaagaccaccag

SEQ ID NO: 1536 - DNA, 23 bp, Artificial sequence
  Synthetic sequence: Probe suitable for detection of genetic variations associated with IBD
agcgcttcttcaaagaccaccag

SEQ ID NO: 1537 - DNA, 23 bp, Artificial sequence
  Synthetic sequence: Probe suitable for detection of genetic variations associated with IBD
cattgcagaccagatcgcactca

SEQ ID NO: 1538 - DNA, 23 bp, Artificial sequence
  Synthetic sequence: Probe suitable for detection of genetic variations associated with IBD
cattgcagaccggatcgcactca

SEQ ID NO: 1539 - DNA, 23 bp, Artificial sequence
  Synthetic sequence: Probe suitable for detection of genetic variations associated with IBD
tgagtgcgatctggtctgcaatg

SEQ ID NO: 1540 - DNA, 23 bp, Artificial sequence
  Synthetic sequence: Probe suitable for detection of genetic variations associated with IBD
tgagtgcgatccggtctgcaatg

SEQ ID NO: 1541 - DNA, 23 bp, Artificial sequence
  Synthetic sequence: Probe suitable for detection of genetic variations associated with IBD
cagagggaagaaagaggcgaagc

SEQ ID NO: 1542 - DNA, 23 bp, Artificial sequence
  Synthetic sequence: Probe suitable for detection of genetic variations associated with IBD
cagagggaagagagaggcgaagc

SEQ ID NO: 1543 - DNA, 23 bp, Artificial sequence
  Synthetic sequence: Probe suitable for detection of genetic variations associated with IBD
gcttcgcctctttcttccctctg

SEQ ID NO: 1544 - DNA, 23 bp, Artificial sequence
  Synthetic sequence: Probe suitable for detection of genetic variations associated with IBD
gcttcgcctctctcttccctctg

SEQ ID NO: 1545 - DNA, 23 bp, Artificial sequence
  Synthetic sequence: Probe suitable for detection of genetic variations associated with IBD
acctggtgatgaatcccttacta

SEQ ID NO: 1546 - DNA, 23 bp, Artificial sequence
  Synthetic sequence: Probe suitable for detection of genetic variations associated with IBD
acctggtgatggatcccttacta

SEQ ID NO: 1547 - DNA, 23 bp, Artificial sequence
  Synthetic sequence: Probe suitable for detection of genetic variations associated with IBD
tagtaagggattcatcaccaggt

SEQ ID NO: 1548 - DNA, 23 bp, Artificial sequence
  Synthetic sequence: Probe suitable for detection of genetic variations associated with IBD
tagtaagggatccatcaccaggt

SEQ ID NO: 1549 - DNA, 23 bp, Artificial sequence
  Synthetic sequence: Probe suitable for detection of genetic variations associated with IBD
gcttgaacctcaaacaattgaag

SEQ ID NO: 1550 - DNA, 23 bp, Artificial sequence
  Synthetic sequence: Probe suitable for detection of genetic variations associated with IBD
gcttgaacctcgaacaattgaag

SEQ ID NO: 1551 - DNA, 23 bp, Artificial sequence
  Synthetic sequence: Probe suitable for detection of genetic variations associated with IBD
cttcaattgtttgaggttcaagc

SEQ ID NO: 1552 - DNA, 23 bp, Artificial sequence
  Synthetic sequence: Probe suitable for detection of genetic variations associated with IBD
cttcaattgttcgaggttcaagc

SEQ ID NO: 1553 - DNA, 23 bp, Artificial sequence
  Synthetic sequence: Probe suitable for detection of genetic variations associated with IBD
aagaagaaaccagggtgggtggt

SEQ ID NO: 1554 - DNA, 23 bp, Artificial sequence
  Synthetic sequence: Probe suitable for detection of genetic variations associated with IBD
aagaagaaaccggggtgggtggt

SEQ ID NO: 1555 - DNA, 23 bp, Artificial sequence
  Synthetic sequence: Probe suitable for detection of genetic variations associated with IBD
accacccaccctggtttcttctt

SEQ ID NO: 1556 - DNA, 23 bp, Artificial sequence
  Synthetic sequence: Probe suitable for detection of genetic variations associated with IBD
accacccaccccggtttcttctt

SEQ ID NO: 1557 - DNA, 23 bp, Artificial sequence
  Synthetic sequence: Probe suitable for detection of genetic variations associated with IBD
ccttggatctccgagacaatgct

SEQ ID NO: 1558 - DNA, 23 bp, Artificial sequence
  Synthetic sequence: Probe suitable for detection of genetic variations associated with IBD
ccttggatctctgagacaatgct

SEQ ID NO: 1559 - DNA, 23 bp, Artificial sequence
  Synthetic sequence: Probe suitable for detection of genetic variations associated with IBD
agcattgtctcggagatccaagg

SEQ ID NO: 1560 - DNA, 23 bp, Artificial sequence
  Synthetic sequence: Probe suitable for detection of genetic variations associated with IBD
agcattgtctcagagatccaagg

SEQ ID NO: 1561 - DNA, 23 bp, Artificial sequence
  Synthetic sequence: Probe suitable for detection of genetic variations associated with IBD
tgaacctggctaccaggacctgg

SEQ ID NO: 1562 - DNA, 23 bp, Artificial sequence
  Synthetic sequence: Probe suitable for detection of genetic variations associated with IBD
tgaacctggctgccaggacctgg

SEQ ID NO: 1563 - DNA, 23 bp, Artificial sequence
  Synthetic sequence: Probe suitable for detection of genetic variations associated with IBD
ccaggtcctggtagccaggttca

SEQ ID NO: 1564 - DNA, 23 bp, Artificial sequence
  Synthetic sequence: Probe suitable for detection of genetic variations associated with IBD
ccaggtcctggcagccaggttca

SEQ ID NO: 1565 - DNA, 23 bp, Artificial sequence
  Synthetic sequence: Probe suitable for detection of genetic variations associated with IBD
caagttactcacatggaaaactg

SEQ ID NO: 1566 - DNA, 23 bp, Artificial sequence
  Synthetic sequence: Probe suitable for detection of genetic variations associated with IBD
caagttactcagatggaaaactg

SEQ ID NO: 1567 - DNA, 23 bp, Artificial sequence
  Synthetic sequence: Probe suitable for detection of genetic variations associated with IBD
cagttttccatgtgagtaacttg

SEQ ID NO: 1568 - DNA, 23 bp, Artificial sequence
  Synthetic sequence: Probe suitable for detection of genetic variations associated with IBD
cagttttccatctgagtaacttg

SEQ ID NO: 1569 - DNA, 23 bp, Artificial sequence
  Synthetic sequence: Probe suitable for detection of genetic variations associated with IBD
gcagaagaaatatgtgagcaagc

SEQ ID NO: 1570 - DNA, 23 bp, Artificial sequence
  Synthetic sequence: Probe suitable for detection of genetic variations associated with IBD
gcagaagaaatgtgtgagcaagc

SEQ ID NO: 1571 - DNA, 23 bp, Artificial sequence
  Synthetic sequence: Probe suitable for detection of genetic variations associated with IBD
gcttgctcacatatttcttctgc

SEQ ID NO: 1572 - DNA, 23 bp, Artificial sequence
  Synthetic sequence: Probe suitable for detection of genetic variations associated with IBD
gcttgctcacacatttcttctgc

SEQ ID NO: 1573 - DNA, 23 bp, Artificial sequence
  Synthetic sequence: Probe suitable for detection of genetic variations associated with IBD
gagataagtttacatgcactttg

SEQ ID NO: 1574 - DNA, 23 bp, Artificial sequence
  Synthetic sequence: Probe suitable for detection of genetic variations associated with IBD
gagataagtttccatgcactttg

SEQ ID NO: 1575 - DNA, 23 bp, Artificial sequence
  Synthetic sequence: Probe suitable for detection of genetic variations associated with IBD
caaagtgcatgtaaacttatctc

SEQ ID NO: 1576 - DNA, 23 bp, Artificial sequence
  Synthetic sequence: Probe suitable for detection of genetic variations associated with IBD
caaagtgcatggaaacttatctc

SEQ ID NO: 1577 - DNA, 23 bp, Artificial sequence
  Synthetic sequence: Probe suitable for detection of genetic variations associated with IBD
gcagccagccccaggccgggagg

SEQ ID NO: 1578 - DNA, 23 bp, Artificial sequence
  Synthetic sequence: Probe suitable for detection of genetic variations associated with IBD
gcagccagcccgaggccgggagg

SEQ ID NO: 1579 - DNA, 23 bp, Artificial sequence
  Synthetic sequence: Probe suitable for detection of genetic variations associated with IBD
cctcccggcctggggctggctgc

SEQ ID NO: 1580 - DNA, 23 bp, Artificial sequence
  Synthetic sequence: Probe suitable for detection of genetic variations associated with IBD
cctcccggcctcgggctggctgc

SEQ ID NO: 1581 - DNA, 23 bp, Artificial sequence
  Synthetic sequence: Probe suitable for detection of genetic variations associated with IBD
ttcaggtgtccatacaggaagtg

SEQ ID NO: 1582 - DNA, 23 bp, Artificial sequence
  Synthetic sequence: Probe suitable for detection of genetic variations associated with IBD
ttcaggtgtccgtacaggaagtg

SEQ ID NO: 1583 - DNA, 23 bp, Artificial sequence
  Synthetic sequence: Probe suitable for detection of genetic variations associated with IBD
cacttcctgtatggacacctgaa

SEQ ID NO: 1584 - DNA, 23 bp, Artificial sequence
  Synthetic sequence: Probe suitable for detection of genetic variations associated with IBD
cacttcctgtacggacacctgaa

SEQ ID NO: 1585 - DNA, 23 bp, Artificial sequence
  Synthetic sequence: Probe suitable for detection of genetic variations associated with IBD
gccctggtggtagacaacacact

SEQ ID NO: 1586 - DNA, 23 bp, Artificial sequence
  Synthetic sequence: Probe suitable for detection of genetic variations associated with IBD
gccctggtggtggacaacacact

SEQ ID NO: 1587 - DNA, 23 bp, Artificial sequence
  Synthetic sequence: Probe suitable for detection of genetic variations associated with IBD
agtgtgttgtctaccaccagggc

SEQ ID NO: 1588 - DNA, 23 bp, Artificial sequence
  Synthetic sequence: Probe suitable for detection of genetic variations associated with IBD
agtgtgttgtccaccaccagggc

SEQ ID NO: 1589 - DNA, 23 bp, Artificial sequence
  Synthetic sequence: Probe suitable for detection of genetic variations associated with IBD
atccagatcctcaaagtgaacat

SEQ ID NO: 1590 - DNA, 23 bp, Artificial sequence
  Synthetic sequence: Probe suitable for detection of genetic variations associated with IBD
atccagatccttaaagtgaacat

SEQ ID NO: 1591 - DNA, 23 bp, Artificial sequence
  Synthetic sequence: Probe suitable for detection of genetic variations associated with IBD
atgttcactttgaggatctggat

SEQ ID NO: 1592 - DNA, 23 bp, Artificial sequence
  Synthetic sequence: Probe suitable for detection of genetic variations associated with IBD
atgttcactttaaggatctggat

SEQ ID NO: 1593 - DNA, 23 bp, Artificial sequence
  Synthetic sequence: Probe suitable for detection of genetic variations associated with IBD
ttttccatacattaaagatagtc

SEQ ID NO: 1594 - DNA, 23 bp, Artificial sequence
  Synthetic sequence: Probe suitable for detection of genetic variations associated with IBD
ttttccatacatggtcctgccgc

SEQ ID NO: 1595 - DNA, 23 bp, Artificial sequence
  Synthetic sequence: Probe suitable for detection of genetic variations associated with IBD
gactatctttaatgtatggaaaa

SEQ ID NO: 1596 - DNA, 23 bp, Artificial sequence
  Synthetic sequence: Probe suitable for detection of genetic variations associated with IBD
gcggcaggaccatgtatggaaaa

SEQ ID NO: 1597 - DNA, 23 bp, Artificial sequence
  Synthetic sequence: Probe suitable for detection of genetic variations associated with IBD
ttgtgtcttgccatgctaaagga

SEQ ID NO: 1598 - DNA, 23 bp, Artificial sequence
  Synthetic sequence: Probe suitable for detection of genetic variations associated with IBD
ttgtgtcttgcgatgctaaagga

SEQ ID NO: 1599 - DNA, 23 bp, Artificial sequence
  Synthetic sequence: Probe suitable for detection of genetic variations associated with IBD
tcctttagcatggcaagacacaa

SEQ ID NO: 1600 - DNA, 23 bp, Artificial sequence
  Synthetic sequence: Probe suitable for detection of genetic variations associated with IBD
tcctttagcatcgcaagacacaa

SEQ ID NO: 1601 - DNA, 23 bp, Artificial sequence
  Synthetic sequence: Probe suitable for detection of genetic variations associated with IBD
tgctcaggagaagggagatgtga

SEQ ID NO: 1602 - DNA, 23 bp, Artificial sequence
  Synthetic sequence: Probe suitable for detection of genetic variations associated with IBD
tgctcaggagaggggagatgtga

SEQ ID NO: 1603 - DNA, 23 bp, Artificial sequence
  Synthetic sequence: Probe suitable for detection of genetic variations associated with IBD
tcacatctcccttctcctgagca

SEQ ID NO: 1604 - DNA, 23 bp, Artificial sequence
  Synthetic sequence: Probe suitable for detection of genetic variations associated with IBD
tcacatctcccctctcctgagca

SEQ ID NO: 1605 - DNA, 23 bp, Artificial sequence
  Synthetic sequence: Probe suitable for detection of genetic variations associated with IBD
ggctgctccccccgtggcccctg

SEQ ID NO: 1606 - DNA, 23 bp, Artificial sequence
  Synthetic sequence: Probe suitable for detection of genetic variations associated with IBD
ggctgctccccgcgtggcccctg

SEQ ID NO: 1607 - DNA, 23 bp, Artificial sequence
  Synthetic sequence: Probe suitable for detection of genetic variations associated with IBD
caggggccacggggggagcagcc

SEQ ID NO: 1608 - DNA, 23 bp, Artificial sequence
  Synthetic sequence: Probe suitable for detection of genetic variations associated with IBD
caggggccacggggggagcagcc

SEQ ID NO: 1609 - DNA, 23 bp, Artificial sequence
  Synthetic sequence: Probe suitable for detection of genetic variations associated with IBD
tagcaccccccaagccaagcaga

SEQ ID NO: 1610 - DNA, 23 bp, Artificial sequence
  Synthetic sequence: Probe suitable for detection of genetic variations associated with IBD
tagcacccccccagccaagcaga

SEQ ID NO: 1611 - DNA, 23 bp, Artificial sequence
  Synthetic sequence: Probe suitable for detection of genetic variations associated with IBD
tctgcttggcttggggggtgcta

SEQ ID NO: 1612 - DNA, 23 bp, Artificial sequence
  Synthetic sequence: Probe suitable for detection of genetic variations associated with IBD
tctgcttggctgggggggtgcta

SEQ ID NO: 1613 - DNA, 23 bp, Artificial sequence
  Synthetic sequence: Probe suitable for detection of genetic variations associated with IBD
cttgctcaggaaaggggagatgt

SEQ ID NO: 1614 - DNA, 23 bp, Artificial sequence
  Synthetic sequence: Probe suitable for detection of genetic variations associated with IBD
cttgctcaggagaggggagatgt

SEQ ID NO: 1615 - DNA, 23 bp, Artificial sequence
  Synthetic sequence: Probe suitable for detection of genetic variations associated with IBD
acatctcccctttcctgagcaag

SEQ ID NO: 1616 - DNA, 23 bp, Artificial sequence
  Synthetic sequence: Probe suitable for detection of genetic variations associated with IBD
acatctcccctctcctgagcaag

SEQ ID NO: 1617 - DNA, 23 bp, Artificial sequence
  Synthetic sequence: Probe suitable for detection of genetic variations associated with IBD
tgctcaggagaagggagatgtga

SEQ ID NO: 1618 - DNA, 23 bp, Artificial sequence
  Synthetic sequence: Probe suitable for detection of genetic variations associated with IBD
tgctcaggagaggggagatgtga

SEQ ID NO: 1619 - DNA, 23 bp, Artificial sequence
  Synthetic sequence: Probe suitable for detection of genetic variations associated with IBD
tcacatctcccttctcctgagca

SEQ ID NO: 1620 - DNA, 23 bp, Artificial sequence
  Synthetic sequence: Probe suitable for detection of genetic variations associated with IBD
tcacatctcccctctcctgagca

SEQ ID NO: 1621 - DNA, 23 bp, Artificial sequence
  Synthetic sequence: Probe suitable for detection of genetic variations associated with IBD
agcgtgaacccaaaaatgtgcgg

SEQ ID NO: 1622 - DNA, 23 bp, Artificial sequence
  Synthetic sequence: Probe suitable for detection of genetic variations associated with IBD
agcgtgaacccgaaaatgtgcgg

SEQ ID NO: 1623 - DNA, 23 bp, Artificial sequence
  Synthetic sequence: Probe suitable for detection of genetic variations associated with IBD
ccgcacatttttgggttcacgct

SEQ ID NO: 1624 - DNA, 23 bp, Artificial sequence
  Synthetic sequence: Probe suitable for detection of genetic variations associated with IBD
ccgcacattttcgggttcacgct

SEQ ID NO: 1625 - DNA, 23 bp, Artificial sequence
  Synthetic sequence: Probe suitable for detection of genetic variations associated with IBD
ctggggatgctacagagaccaga

SEQ ID NO: 1626 - DNA, 23 bp, Artificial sequence
  Synthetic sequence: Probe suitable for detection of genetic variations associated with IBD
ctggggatgctgcagagaccaga

SEQ ID NO: 1627 - DNA, 23 bp, Artificial sequence
  Synthetic sequence: Probe suitable for detection of genetic variations associated with IBD
tctggtctctgtagcatccccag

SEQ ID NO: 1628 - DNA, 23 bp, Artificial sequence
  Synthetic sequence: Probe suitable for detection of genetic variations associated with IBD
tctggtctctgcagcatccccag

SEQ ID NO: 1629 - DNA, 23 bp, Artificial sequence
  Synthetic sequence: Probe suitable for detection of genetic variations associated with IBD
actgggaccaacagaatcgaagt

SEQ ID NO: 1630 - DNA, 23 bp, Artificial sequence
  Synthetic sequence: Probe suitable for detection of genetic variations associated with IBD
actgggaccaatagaatcgaagt

SEQ ID NO: 1631 - DNA, 23 bp, Artificial sequence
  Synthetic sequence: Probe suitable for detection of genetic variations associated with IBD
acttcgattctgttggtcccagt

SEQ ID NO: 1632 - DNA, 23 bp, Artificial sequence
  Synthetic sequence: Probe suitable for detection of genetic variations associated with IBD
acttcgattctattggtcccagt

SEQ ID NO: 1633 - DNA, 23 bp, Artificial sequence
  Synthetic sequence: Probe suitable for detection of genetic variations associated with IBD
accaagaaggcctcaggcacgat

SEQ ID NO: 1634 - DNA, 23 bp, Artificial sequence
  Synthetic sequence: Probe suitable for detection of genetic variations associated with IBD
accaagaaggcttcaggcacgat

SEQ ID NO: 1635 - DNA, 23 bp, Artificial sequence
  Synthetic sequence: Probe suitable for detection of genetic variations associated with IBD
atcgtgcctgaggccttcttggt

SEQ ID NO: 1636 - DNA, 23 bp, Artificial sequence
  Synthetic sequence: Probe suitable for detection of genetic variations associated with IBD
atcgtgcctgaagccttcttggt

SEQ ID NO: 1637 - DNA, 23 bp, Artificial sequence
  Synthetic sequence: Probe suitable for detection of genetic variations associated with IBD
atgggcattttcagaattctccc

SEQ ID NO: 1638 - DNA, 23 bp, Artificial sequence
  Synthetic sequence: Probe suitable for detection of genetic variations associated with IBD
atgggcatttttagaattctccc

SEQ ID NO: 1639 - DNA, 23 bp, Artificial sequence
  Synthetic sequence: Probe suitable for detection of genetic variations associated with IBD
gggagaattctgaaaatgcccat

SEQ ID NO: 1640 - DNA, 23 bp, Artificial sequence
  Synthetic sequence: Probe suitable for detection of genetic variations associated with IBD
gggagaattctaaaaatgcccat

SEQ ID NO: 1641 - DNA, 23 bp, Artificial sequence
  Synthetic sequence: Probe suitable for detection of genetic variations associated with IBD
acagcaatttagtataggattcc

SEQ ID NO: 1642 - DNA, 23 bp, Artificial sequence
  Synthetic sequence: Probe suitable for detection of genetic variations associated with IBD
acagcaatttattataggattcc

SEQ ID NO: 1643 - DNA, 23 bp, Artificial sequence
  Synthetic sequence: Probe suitable for detection of genetic variations associated with IBD
ggaatcctatactaaattgctgt

SEQ ID NO: 1644 - DNA, 23 bp, Artificial sequence
  Synthetic sequence: Probe suitable for detection of genetic variations associated with IBD
ggaatcctataataaattgctgt

SEQ ID NO: 1645 - DNA, 23 bp, Artificial sequence
  Synthetic sequence: Probe suitable for detection of genetic variations associated with IBD
ctaggtcagctcaagatcctgtg

SEQ ID NO: 1646 - DNA, 23 bp, Artificial sequence
  Synthetic sequence: Probe suitable for detection of genetic variations associated with IBD
ctaggtcagctgaagatcctgtg

SEQ ID NO: 1647 - DNA, 23 bp, Artificial sequence
  Synthetic sequence: Probe suitable for detection of genetic variations associated with IBD
cacaggatcttgagctgacctag

SEQ ID NO: 1648 - DNA, 23 bp, Artificial sequence
  Synthetic sequence: Probe suitable for detection of genetic variations associated with IBD
cacaggatcttcagctgacctag

SEQ ID NO: 1649 - DNA, 23 bp, Artificial sequence
  Synthetic sequence: Probe suitable for detection of genetic variations associated with IBD
gtcccgtctccacaggctaggca

SEQ ID NO: 1650 - DNA, 23 bp, Artificial sequence
  Synthetic sequence: Probe suitable for detection of genetic variations associated with IBD
gtcccgtctccgcaggctaggca

SEQ ID NO: 1651 - DNA, 23 bp, Artificial sequence
  Synthetic sequence: Probe suitable for detection of genetic variations associated with IBD
tgcctagcctgtggagacgggac

SEQ ID NO: 1652 - DNA, 23 bp, Artificial sequence
  Synthetic sequence: Probe suitable for detection of genetic variations associated with IBD
tgcctagcctgcggagacgggac

SEQ ID NO: 1653 - DNA, 50 bp, Artificial sequence
  Synthetic sequence: External control DNA CEH
gtcgtcaagatgctaccgttcaggagtcgtcaagatgctaccgttcagga

SEQ ID NO: 1654 - DNA, 19 bp, Artificial sequence
  Synthetic sequence: Probe ON1 suitable for the detection of the external control nucleic acid of SEQ ID NO: 1653
cttgacgactcctgaacgg

SEQ ID NO: 1655 - DNA, 19 bp, Artificial sequence
  Synthetic sequence: Probe ON2 suitable for the detection of the external control nucleic acid of SEQ ID NO: 1653
cttgacgacacctgaacgg

SEQ ID NO: 1656 - DNA, 23 bp, Artificial sequence
  Synthetic oligonucleotide
ctgcaaccagtttcctcttgggt

SEQ ID NO: 1657 - DNA, 23 bp, Artificial sequence
  Synthetic oligonucleotide
ctgcaaccagtctcctcttgggt

SEQ ID NO: 1658 - DNA, 23 bp, Artificial sequence
  Synthetic oligonucleotide
gaggtgagcccagaggcagggcc

SEQ ID NO: 1659 - DNA, 23 bp, Artificial sequence
  Synthetic oligonucleotide
gaggtgagcccggaggcagggcc

SEQ ID NO: 1660 - DNA, 25 bp, Artificial sequence
  Synthetic oligonucleotide
ttttttttacctctttgatagtaaa

SEQ ID NO: 1661 - DNA, 25 bp, Artificial sequence
  Synthetic oligonucleotide
ttttttttacctttttgatagtaaa

SEQ ID NO: 1662 - DNA, 23 bp, Artificial sequence
  Synthetic oligonucleotide
tttttttacctctttgatagtaa

SEQ ID NO: 1663 - DNA, 23 bp, Artificial sequence
  Synthetic oligonucleotide
tttttttacctttttgatagtaa

SEQ ID NO: 1664 - DNA, 23 bp, Artificial sequence
  Synthetic oligonucleotide
ggctgaccctcccgggggctgca

SEQ ID NO: 1665 - DNA, 23 bp, Artificial sequence
  Synthetic oligonucleotide
ggctgaccctcctgggggctgca

SEQ ID NO: 1666 - DNA, 25 bp, Artificial sequence
  Synthetic oligonucleotide
tggtaaatcctgtaactgaagtcaa

SEQ ID NO: 1667 - DNA, 25 bp, Artificial sequence
  Synthetic oligonucleotide
tggtaaatcctggaactgaagtcaa

SEQ ID NO: 1668 - DNA, 39 bp, Artificial sequence
  Synthetic oligonucleotide
gccgcgaattcactagtgtcttggtaggtgcaccaatgt

SEQ ID NO: 1669 - DNA, 46 bp, Artificial sequence
  Synthetic oligonucleotide
ggccgcgggaattcgattgatgaaatgtaaaccatactatctgtgc

We claim:

1. An in vitro method for genotyping genetic variations in an individual, the method comprising:
   (a) providing a sample containing nucleic acid which comprises the genetic variations to be genotyped (the target DNA),
   (b) providing, for each genetic variation to be genotyped, oligonucleotide probe pairs, wherein,
      (i) one probe in each pair is capable of hybridising to genetic variation A and the other probe in each pair is capable of hybridising to genetic variation B;
      (ii) each probe is provided in replicates; and
      (iii) the probe replicates are each coupled to a solid support, wherein the solid support is a particle;
   (c) amplifying and detectably labelling the target DNA;
   (d) contacting the target DNA with the probes under conditions which allow hybridization to occur, thereby forming detectably labeled nucleic acid-probe hybridization complexes,
   (e) determining the intensity of detectable label for each probe, thereby obtaining a raw intensity value for each particle type;
   (f) optionally amending the raw intensity value to take account of background noise, thereby obtaining a clean intensity value for each replica; and
   (g) applying an algorithm to the intensity data from (e) or (f), thereby determining the genotype with respect to each genetic variation,
   wherein application of the algorithm comprises calculating a raw intensity value from the intensity values for each of the replicas of each probe coupled with a particle, and wherein the algorithm comprises deriving:
      a first linear function: $a1 ratio1 + b1 ratio2 + c1$ that characterizes genotype AA:
      a second linear function: $a2 ratio1 + b2 ratio2 + c2$ that characterizes genotype AB; and
      a third linear function: $a3 ratio1 + b3 ratio2 + c3$ that characterizes genotype BB;
   wherein:
      AA represents the genotype of a homozygote subject for the allelic variant 1 (allele 1);
      AB represents the genotype of a heterozygote subject for the allelic variants 1 and 2 (allele 1 and allele 2);
      BB represents the genotype of a homozygote subject for the allelic variant 2 (allele 2);
      $a1$ is the coefficient which accompanies the X in the linear function for the genotype AA; $a1$ being obtained by applying a discriminate analysis to the ratios 1 and 2 obtained from analysing Z patients for the genotype AA, Z for BB and Z for AB, wherein Z is a number more than two,
      $b1$ is the coefficient which accompanies the Y in the linear function for the genotype AA; $b1$ being obtained by applying a discriminate analysis to the ratios 1 and 2 obtained from analysing Z patients for the genotype AA, Z for BB and Z for AB;

c1 is the independent term of the first linear function;

a2 is the coefficient which accompanies the X in the linear function for the genotype AB; a2 being obtained by applying a discriminate analysis to the ratios 1 and 2 obtained from analysing Z patients for the genotype AA, Z for BB and Z for AB;

b2 is the coefficient which accompanies the Y in the linear function for the genotype AB; b2 being obtained by applying a discriminate analysis to the ratios 1 and 2 obtained from analysing Z patients for the genotype AA, Z for BB and Z for AB;

c2 is the independent term of the second linear function;

a3 is the coefficient which accompanies the X in the linear function for the genotype BB; a3 being obtained by applying a discriminate analysis to the ratios 1 and 2 obtained from analysing Z patients for the AA, Z for BB and Z for AB;

b3 is the coefficient which accompanies the Y in the linear function for the genotype BB; b3 being obtained by applying the discriminate analysis to the ratios 1 and 2 obtained from analysing Z patients for the genotype AA, Z for BB and Z for AB;

c3 is the independent term of the third linear function;

one probe is used for each allele, comprising probes 1 and 2 (oligo 1 and oligo 2), wherein probe 1 corresponds to allele one and probe 2 corresponds to allele two;

ratio 1 is the proportion of the median of the intensities of the particles of the same type linked to oligo 1 which detects the allele one divided by the median of the intensities of the oligo 1 plus the median of the intensities of intensities of the particles of the same type linked to oligo 2 and can be calculated by the equation:

$$\text{ratio } 1 = \frac{\text{median oligo intensity oligo 1}}{\text{median oligo intensity oligo 1} + \text{median oligo intensity oligo 2}}$$

and ratio 2 is the proportion of the median of the intensities of the particles of the same type linked to oligo 2 which detects the allele two divided by the median of the intensities of the oligo 1 plus the median of the intensities of intensities of the particles of the same type linked to oligo 2 and can be calculated by the equation:

$$\text{ratio } 2 = \frac{\text{median oligo intensity oligo 2}}{\text{median oligo intensity oligo 1} + \text{median oligo intensity oligo 2}}.$$

2. The method of claim 1, wherein the particles are nanoparticles.

3. The method of claim 1, wherein the particles are microparticles.

4. The method of claim 1, wherein the particles are in a suspension buffer.

5. The method of claim 1 wherein the genetic variations comprise single nucleotide polymorphisms (SNPs), insertions, deletions, or gene rearrangements.

6. The method of claim 1 wherein the genetic variations are associated with IBD, erythrocyte and human platelet antigens, Multiple Sclerosis, Rheumatoid Arthritis, Prostate Cancer, Osteoporosis, Familial Hypercholesterolemia, or adverse reactions to pharmaceuticals.

7. The method of claim 1 wherein amplification is carried out using the polymerase chain reaction (PCR).

8. A method according to claim 7 which comprises use of at least one pair of PCR primers selected from those in SEQ ID NOS 1457-1458.

9. The method of claim 1, further comprising fragmentation of the amplified products.

10. The method of claim 9 wherein the products are biotinylated during the PCR process by inclusion of a biotinylated nucleotide.

11. The method of claim 9 wherein the products are biotinylated following PCR and fragmentation.

12. The method of claim 1 wherein the detectable label is chosen from the group comprising a fluorescent label, a radioactive label, or a chemical label.

13. The method of claim 1 wherein the detectable label is a streptavidin-phycoerthrine conjugate.

14. The method of claim 1, further comprising extracting the nucleic acid from a biological sample obtained from an individual.

15. The method of claim 14 wherein:
(a) the nucleic acid extracted from the sample is DNA or RNA; and/or
(b) the method further comprises producing cDNA from extracted RNA.

16. The method of claim 1 wherein the intensity of detectable label and the type of particle is determined using a flow cytometer.

17. The method of claim 1 wherein the particles comprise particle types with different known fluorescent light absorbance intensities.

18. The method of claim 1 wherein each probe is attached to a different type of particle.

19. The method of claim 1 wherein calculating the median intensity value for each probe comprises eliminating outlying intensity values.

20. An in vitro method for genotyping genetic variations in an individual, the method comprising:
(a) providing a sample containing nucleic acid which comprises the genetic variations to be genotyped (the target DNA);
(b) providing, for each genetic variation to be genotyped, oligonucleotide probe pairs, wherein,
  (i) one probe in each pair is capable of hybridising to genetic variation A and the other probe in each pair is capable of hybridising to genetic variation B;
  (ii) each probe is provided in replicates; and
  (iii) the probe replicates are each coupled to a solid support, wherein the solid support is a particle;
(c) amplifying and detectably labelling the target DNA;
(d) contacting the target DNA with the probes under conditions which allow hybridization to occur, thereby forming detectably labeled nucleic acid-probe hybridization complexes;
(e) determining the intensity of detectable label for each probe, thereby obtaining a raw intensity value for each particle type;
(f) optionally amending the raw intensity value to take account of background noise, thereby obtaining a clean intensity value for each replica; and
(g) applying an algorithm to the intensity data from (e) or (f), thereby determining the genotype with respect to each genetic variation,
wherein application of the algorithm comprises calculating a raw intensity value from the intensity values for each of the replicas of each probe coupled with a particle, and wherein the algorithm comprises deriving:

a first linear function: a1ratio1+b1ratio2+c1 that characterizes genotype AA;
a second linear function: a2ratio1+b2ratio2+c2 that characterizes genotype AB; and
a third linear function: a3ratio1+b3ratio2+c3 that characterizes genotype BB;
wherein:
AA represents the genotype of a homozygote subject for the allelic variant 1 (allele 1);
AB represents the genotype of a heterozygote subject for the allelic variants 1 and 2 (allele 1 and allele 2);
BB represents the genotype of a homozygote subject for the allelic variant 2 (allele 2);
a1 is the coefficient which accompanies the X in the linear function for the genotype AA; a1 being obtained by applying a discriminate analysis to the ratios 1 and 2 obtained from analysing Z patients for the genotype AA, Z for BB and Z for AB, wherein Z is a number more than two,
b1 is the coefficient which accompanies the Y in the linear function for the genotype AA; b1 being obtained by applying a discriminate analysis to the ratios 1 and 2 obtained from analysing Z patients for the genotype AA, Z for BB and Z for AB;
c1 is the independent term of the first linear function;
a2 is the coefficient which accompanies the X in the linear function for the genotype AB; a2 being obtained by applying a discriminate analysis to the ratios 1 and 2 obtained from analysing Z patients for the genotype AA, Z for BB and Z for AB;
b2 is the coefficient which accompanies the Y in the linear function for the genotype AB; b2 being obtained by applying a discriminate analysis to the ratios 1 and 2 obtained from analysing Z patients for the genotype AA, Z for BB and Z for AB;
c2 is the independent term of the second linear function;
a3 is the coefficient which accompanies the X in the linear function for the genotype BB; a3 being obtained by applying a discriminate analysis to the ratios 1 and 2 obtained from analysing Z patients for the genotype AA, Z for BB and Z for AB;
b3 is the coefficient which accompanies the Y in the linear function for the genotype BB; b3 being obtained by applying a discriminate analysis to the ratios 1 and 2 obtained from analysing Z patients for the genotype AA, Z for BB and Z for AB;
c3 is the independent term of the third linear function;
two probes are used for each allele, comprising probes 1, 2, 3 and 4, wherein probe 1 (oligo 1) corresponds to allele 1, probe 2 (oligo 2) corresponds to allele 2, probe 3 (oligo 3) corresponds to allele 1, and probe 4 (oligo 4) corresponds to allele 2;
ratio 1 is the proportion of the median of the intensities of the particles of the same type linked to oligo 1 which detects the allele one divided by the median of the intensities of the oligo 1 plus the median of the intensities of intensities of the particles of the same type linked to oligo 2 and can be calculated by the equation:

$$\text{Ratio 1} = \frac{\text{Median oligo intensity oligo 1}}{\text{Median oligo intensity oligo 1} + \text{Median oligo intensity oligo 2}}$$

and
ratio 2 is the proportion of the median of the intensities of the particles of the same type linked to oligo 3 which detects the allele one divided by the median of the intensities of the oligo 3 plus the median of the intensities of intensities of the particles of the same type linked to oligo 4 and can be calculated by the equation:

$$\text{Ratio 2} = \frac{\text{Median oligo intensity oligo 3}}{\text{Median oligo intensity oligo 3} + \text{Median oligo intensity oligo 4}}.$$

21. The method of claim 1, wherein the genotyping of said allelic variants comprises:
grouping the corresponding intensities data of each type of oligonucleotide coupled with a uniquely identifiable type of particle which has been used to characterize each mutation;
calculating the median intensity value for each one of the 2 oligonucleotide probes using the intensities of the particles coupled with each different oligonucleotide probe in order to eliminate outliers;
calculating ratios 1 and 2 for each; and
determining genotype of the patient.

22. The method of claim 1, wherein Z is 10.

23. The method of claim 1, further comprising predicting a phenotype in a subject, wherein the predicting a phenotype in a subject comprises analysis of a plurality of genetic variations in order to determine a haplotype and make an allele call, and using the allele call to predict the phenotype.

24. The method of claim 23, wherein the analysis of a plurality of genetic variations further comprises software to complete the analysis.

25. The method of claim 1, wherein the particles are cylindrical microparticles encoded with a barcode, and wherein the barcode is read by a barcode scanner.

26. The method of claim 1, wherein the linear function is a Fisher linear function.

27. The method of claim 1, wherein the raw intensity value is a median intensity value.

28. The method of claim 10 wherein more than one pair of primers is used to amplify the desired sequence.

29. The method of claim 10 wherein the products are biotinylated during the PCR process by inclusion of a plurality of biotinylated nucleotides.

30. The method of claim 20, wherein the particles are nanoparticles.

31. The method of claim 20, wherein the particles are microparticles.

32. The method of claim 20, wherein the particles are in a suspension buffer.

33. The method of claim 20, wherein the genetic variations comprise single nucleotide polymorphisms (SNPs), insertions, deletions, or gene rearrangements.

34. The method of claim 20, wherein the genetic variations are associated with IBD, erythrocyte and human platelet antigens, Multiple Sclerosis, Rheumatoid Arthritis, Prostate Cancer, Osteoporosis, Familial Hypercholesterolemia, or adverse reactions to pharmaceuticals.

35. The method of claim 20, wherein amplification is carried out using the polymerase chain reaction (PCR).

36. The method of claim 35, which comprises use of at least one pair of PCR primers selected from those in SEQ ID NOS: 1457-1458.

37. The method of claim 20, further comprising fragmentation of the amplified products.

38. The method of claim 37, wherein the products are biotinylated during the PCR process by inclusion of a biotinylated nucleotide.

39. The method of claim 37, wherein more than one pair of primers is used to amplify the desired sequence.

40. The method of claim 37, wherein the products are biotinylated during the PCR process by inclusion of a plurality of biotinylated nucleotides.

41. The method of claim 37, wherein the products are biotinylated following PCR and fragmentation.

42. The method of claim 20, wherein the detectable label is chosen from the group comprising a fluorescent label, a radioactive label, or a chemical label.

43. The method of claim 20, wherein the detectable label is a streptavidin-phycoerthrine conjugate.

44. The method of claim 20, further comprising extracting the nucleic acid from a biological sample obtained from an individual.

45. The method of claim 44, wherein:
   (a) the nucleic acid extracted from the sample is DNA or RNA; and/or
   (b) the method further comprises producing cDNA from extracted RNA.

46. The method of claim 20, wherein the intensity of detectable label and the type of particle is determined using a flow cytometer.

47. The method of claim 20, wherein the particles comprise particle types with different known fluorescent light absorbance intensities.

48. The method of claim 20, wherein each probe is attached to a different type of particle.

49. The method of claim 20, wherein calculating the median intensity value for each probe comprises eliminating outlying intensity values.

50. The method of claim 20, wherein the genotyping of said allelic variants comprises:
   grouping the corresponding intensities data of each type of oligonucleotide coupled with a uniquely identifiable type of particle which has been used to characterize each mutation;
   calculating the median intensity value for each one of the 4 oligonucleotide probes using the intensities of the particles coupled with each different oligonucleotide probe in order to eliminate outliers;
   calculating ratios 1 and 2 for each; and
   determining genotype of the patient.

51. The method of claim 20, wherein Z is 10.

52. The method of claim 20, further comprising predicting a phenotype in a subject, wherein the predicting a phenotype in a subject comprises analysis of a plurality of genetic variations in order to determine a haplotype and make an allele call, and using the allele call to predict the phenotype.

53. The method of claim 52, wherein the analysis of a plurality of genetic variations further comprises use of software to complete the analysis.

54. The method of claim 20, wherein the particles are cylindrical microparticles encoded with a barcode, and wherein the barcode is read by a barcode scanner.

55. The method of claim 20, wherein the linear function is a Fisher linear function.

56. The method of claim 20, wherein the raw intensity value is a median intensity value.

\* \* \* \* \*

UNITED STATES PATENT AND TRADEMARK OFFICE
CERTIFICATE OF CORRECTION

PATENT NO.         : 8,153,363 B2
APPLICATION NO.    : 12/499076
DATED              : April 10, 2012
INVENTOR(S)        : Buela et al.

Page 1 of 1

It is certified that error appears in the above-identified patent and that said Letters Patent is hereby corrected as shown below:

Column 6, line 9, "of the intensities of intensities" should read --of the intensities--.

Column 6, line 23, "of the intensities of intensities" should read --of the intensities--.

Column 7, line 14, "which s patients" should read --which characterizes patients--.

Column 7, line 27, "of the intensities of intensities" should read --of the intensities--.

Column 7, line 41, "of the intensities of intensities" should read --of the intensities--.

Column 7, line 54, "with the a uniquely" should read --with a uniquely--.

Column 24, line 61, "in specific." should read --non-specific.--.

Column 32, lines 31-32, "Smaller chips 400" should read --Smaller chips with 400--.

Column 37, line 8, "μm2" should read --$\mu m^2$--.

Column 56, line 53, "in the in the" should read --in the--.

Claim 1, Column 59, lines 31-32, "of the intensities of intensities" should read --of the intensities--.

Claim 1, Column 59, lines 44-45, "of the intensities of intensities" should read --of the intensities--.

Claim 20, Column 61, lines 55-56, "of the intensities of intensities" should read --of the intensities--.

Claim 20, Column 62, lines 5-6, "of the intensities of intensities" should read --of the intensities--.

Signed and Sealed this
Twentieth Day of November, 2012

David J. Kappos
*Director of the United States Patent and Trademark Office*